US009475847B2

(12) United States Patent
Altier et al.

(10) Patent No.: US 9,475,847 B2
(45) Date of Patent: Oct. 25, 2016

(54) INSECTICIDAL PROTEINS AND METHODS FOR THEIR USE

(71) Applicants: PIONEER HI BRED INTERNATIONAL INC, Johnston, IA (US); E.I. du PONT de NEMOURS and COMPANY, Wilmington, DE (US)

(72) Inventors: Daniel J. Altier, Granger, IA (US); Jennifer K. Barry, Ames, IA (US); Carol A. Hendrick, Des Moines, IA (US); Lu Liu, Palo Alto, CA (US); Phillip A. Patten, Menlo Park, CA (US); Claudia D. Perez-Ortega, Wilmington, DE (US); Eric J. Schepers, Port Deposit, MD (US); Weiping Xie, East Palo Alto, CA (US); Nasser Yalpani, Johnston, IA (US); Jianzhou Zhao, Johnston, IA (US); Xiaohong Zhong, San Leandro, CA (US); Genhai Zhu, San Jose, CA (US)

(73) Assignees: PIONEER HI-BRED INTERNATIONAL, INC., Johnston, IA (US); E.I. DU PONT DE NEMOURS AND COMPANY, Wilmington, DE (US)

( * ) Notice: Subject to any disclaimer, the term of this patent is extended or adjusted under 35 U.S.C. 154(b) by 662 days.

(21) Appl. No.: 13/800,233

(22) Filed: Mar. 13, 2013

(65) Prior Publication Data

US 2014/0033361 A1 Jan. 30, 2014

Related U.S. Application Data

(60) Provisional application No. 61/739,468, filed on Dec. 19, 2012, provisional application No. 61/675,950, filed on Jul. 26, 2012.

(51) Int. Cl.
*C07K 14/225* (2006.01)
*A01N 37/46* (2006.01)

(Continued)

(52) U.S. Cl.
CPC ............ *C07K 14/195* (2013.01); *A01N 37/46* (2013.01); *A01N 63/02* (2013.01); *C07K 14/225* (2013.01); *C12N 15/8286* (2013.01)

(58) Field of Classification Search
CPC ........................... C07K 14/195; C12N 15/82
See application file for complete search history.

(56) References Cited

U.S. PATENT DOCUMENTS

| | | | | |
|---|---|---|---|---|
| 2005/0074431 | A1 | 4/2005 | Martin et al. | |
| 2010/0162432 | A1 * | 6/2010 | Puzio ................ | C12N 15/8271 800/276 |
| 2012/0102595 | A1 | 4/2012 | English et al. | |

FOREIGN PATENT DOCUMENTS

| | | | |
|---|---|---|---|
| WO | 2004/002223 | A2 | 1/2004 |
| WO | 2004/067727 | A2 | 8/2004 |
| WO | 2008/142036 | A2 | 11/2008 |

OTHER PUBLICATIONS

Barloy, F., et al., "Cloning and sequencing of three new putative toxin genes from Clostridium bifermentans CH18." Gene 211.2 (1998): 293-299.*

(Continued)

*Primary Examiner* — Russell Kallis
*Assistant Examiner* — Weihua Fan
(74) *Attorney, Agent, or Firm* — Pioneer Hi-Bred Int'l

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

46 Claims, 17 Drawing Sheets

(51) Int. Cl.

| | |
|---|---|
| ***C07K 14/195*** | (2006.01) |
| ***A01N 63/02*** | (2006.01) |
| ***C12N 15/82*** | (2006.01) |

(56) References Cited

OTHER PUBLICATIONS

Barloy, F. et al.; "Cloning and sequencing of three new putative toxin genes from Clostridium bifermentans CH18", Gene, Elsevier, vol. 211 (2): pp. 293-299 (1998).

Sevim, Ali et. al. ; "Bacteria from Ips sexdentatus (Coleoptera: Curculionidae) and their biocontrol potential", Journal of Basic Microbiology, vol. 52(6): pp. 695-704 (2012).

Osborn, Frances et al; "Pathogenic effects of bacteria isolated from larvae of HYlesia metabus Crammer (Lepidoptera: Saturniidae)", Journal of Invertebrate Pathology, vol. 80(1): pp. 7-12 (2002).

Yaman,Mustafa et al; "Two bacterial pathogens of Helicoverpa armigera (Hubner) (Lepidoptera: Noctuidae)", Proceedings of the Entomological Society of Washington, vol. 107(3) pp. 623-626 (2005).

Otsu Y et al; "Biological control of phytophagous ladybird beetles Epilachna vigintioctopunctata (Col. Coccinellidae) by chitinolytic phylloplane bacteria Alcaligenes paradoxus entrapped in alginate beads", Journal of Applied Entomology, vol. 127(8): pp. 441-446 (2003).

Molina, C.A. et al; "Selection of a Bacillus pumilus Strain Highly Active against Ceratitis capitata (Wiedemann) Larvae", Applied and Enviromental Microbiology, vol. 76(5): pp. 1320-1327 (2010).

Hogenkamp et al; "Characterization and expression of the beta-N-acetylhexosaminidase gene family of *Tribiolium castaneum,"* Inesect Biochemistry and Molecular Biology, Elsevier Science LTD, vol. 38(4): pp. 478-489 (2008).

Park, Hae Woong et al; "Effects of associated bacteria on the pathogenicity and reproduction of the insect-parasitic nematode Rhabditis blumi (Nematoda: Rhabitida)", Canadian Journal of Microbiology, vol. 57(9): pp. 750-758 (2011).

UniProt, Jan. 11, 2011, "SubName: Full=CRE-Jun-1 protein;", retrieved from EBI accession No. UniProt:E3LG72 sequence.

UniProt, Sep. 5, 2006, "SubName:Full=Prephenate dehydratase (PDT); EC=4.2.1.51" retreived from EBI accession No. UniProt: QORKT6 sequence.

UniProt, Dec. 6, 2005, "RecName: Full=Fumarate hydratase class II; Short=Fumarase C; EC=4.2.1.2;" retrieved EBI accession No. UniProt:Q31FU4 sequence.

EMBL, Jan. 9, 2010, "Canditaus Liberibacter asiaticus Predicted tRNA (5-methylaminomethyl-2-thiouridylate)", retrieved from EBI accession No. EMBL: BAI66007.

NCBI, Dec. 17, 2014, hypothetical protein Slin_6117[Spirosoma linguale DSM 74], retrieved from NCBI accession No. YP_003390878.

NCBI, Dec. 24, 2013, "Aegerolysin [Spirosoma linguale DSM 74]", retrieved from GenBank: ADB42080.1.

International Search Report and Written Opinion for PCT/US2013/052254 mailed Oct. 11, 2013.

* cited by examiner

Fig. 1

```
                           1                                                50
                           HHHHHHHHHHHHHHHHHHHHBBBBBBB          TT  TTTTT   TT T
   AfIP-1A-31        (1)   MTAKDIATEESKIRAYAQWIEITIFVVNSNFKVEGAYLRWGKFHVPGDKD
AfIP-1A-15554        (1)   MTAKDIATEESKIRAYAQWIEITIFVVNSNFKVEGAYLRWGKFHVPGDKD
AfIP-1A-27066        (1)   MTAKDIATEESKIRAYAQWIEITIFVVNSNFKVEGAYLKWGKFHVPGDKD
AfIP-1A-33585        (1)   MTAKDIATEESKVRAYAQWIEITIFVVNSNFKVEGAYLKWGKFHVPGDKD
     SLIN6118        (1)   -------------MAYSEWVEIRIYSENMEIKIKNIKLNWGKFYEGPNQD
      FGTW-51        (1)   ------MDLNVEVQAQSQWVEIEIFSENMDIEIKKAELLWGKFHKPGNKS

                           51                                              100
                           TT         BBBBTTTTTTT  TTT          TTT  TTTT BBBBTT
   AfIP-1A-31       (51)   KEISPSQINGTIIKDEDSYTIASCGRENASSGTEGGFSLYDGDKLVFEYY
AfIP-1A-15554       (51)   KEISPSQINGTIIKDEDSYTIASCGRENASSGTEGGFSLYDGDKLVFEYY
AfIP-1A-27066       (51)   KEITPSQINGTIIKDEDSYTIASCGRENASSGTEGGFSLYDGDKLVFEYY
AfIP-1A-33585       (51)   KEITPSQINGTIIKDEDSYTIASCGRENASSGTEGGFSLYDGDKLVFEYY
     SLIN6118       (38)   IEITAPVLSDAVIKSGEKYTVWSCGRDGASSGTEGSFELYDGDTQVARFG
      FGTW-51       (45)   NEISSDTVNKTKISSGTKSKIASCGRADTSSGTEGKFEIYHDDKWLATYK

                           101                                          148
                           TT TT       HHHHHHHHH  HBBBTTT         BBBBBBBTT
   AfIP-1A-31      (101)   WDCPWSGSNSDELTVKDKEN--YTVIKKGGGSPSGATGNIFITVVKKS
AfIP-1A-15554      (101)   WDCPWSGSNSDELTVKDKEN--YTVIKKGGGSPSGATGNIFITVVKKS
AfIP-1A-27066      (101)   WDCPWSGSNSDELTVKDKEN--YTVSKKGGGSPSGATGNIFITVVKKS
AfIP-1A-33585      (101)   WDCPWSGSNSDELTVKDKEN--YTVSKKGGGSPSGATGNIFITVVKKS
     SLIN6118       (88)   WICPWSGANSCSLIPGEQENKLYKTARQWSGLTSGPLGTITLSCVKLL
      FGTW-51       (95)   WDCPWAGSNSHSLSVTQDND--YKIDKEGGNISDGALGNIRITCIKVG

   AfIP-1A-31      SEQ ID NO: 2
AfIP-1A-15554      SEQ ID NO: 28
AfIP-1A-27066      SEQ ID NO: 32
AfIP-1A-33585      SEQ ID NO: 36
     SLIN6118      SEQ ID NO: 14
      FGTW-51      SEQ ID NO: 18
```

Fig. 2A

```
                          1                                                50
  AfIP-1B-32      (1)    ---MDIEAKSINPLMGITVGSTVLGN--DFKPSVLIN--------PITRM
  AfIP-1B-15554   (1)    ---MDIEAKSINPLMGITVGSTVLGN--DFKPSVLIN--------PITRM
  AfIP-1B-27066   (1)    ---MDIEAKSINPLLGITVGSTVLGN--DFKPSVLIN--------PITRM
  AfIP-1B-33585   (1)    ---MDIEAKSINPLLGITVGSTVLGN--DFKPSVLIN--------PITRM
  SLIN6117        (1)    MSKTASTELRYNPFYAVRVGSTIDGNTSQFFPTVIADTDASDKPVAITTI
  FGTW-52         (1)    ---MKTQIEIVNPFAGVKIGSYVSGN--QFSPSVITG--------DITRM

                          51                                              100
  AfIP-1B-32      (38)   ITQKEIEMGMSGKSQYVYTDSLNEGTIGFSGAYGPSGIAKFTSAVAVSVS
  AfIP-1B-15554   (38)   ITQKEIEMGMSGKSQYVYTDSLNEGTIGFSGAYGPSGIAKFTSAVAVSVS
  AfIP-1B-27066   (38)   ITQKEIEMGMSGKSQYVYTDSLNEGTIGFSGAYGPSGIAKFTSAVAVSVS
  AfIP-1B-33585   (38)   ITQKEIEMGMSGKSQYVYTDSLNEGTIGFSGAYGPSGIAKFTSAVAVSVS
  SLIN6117        (51)   SAEKDMRTSMTGESSYVYNDQMNQGSLGVAGSYGVSGVSKVSAAVSVYAG
  FGTW-52         (38)   EEVLEVQKYISGESNYVYSDKLNEASLGVSGAYGVTGVSKLTSSVSAHAG

                          101                                             150
  AfIP-1B-32      (88)   NATASEYKSIKVSYNISMISGIEYIDFDNLTVEDVLNSLSAGPKNLSLKV
  AfIP-1B-15554   (88)   NATASEYKSIKVSYNISMISGIEYIDFDNLTVEDVLNSLSAGPKNLSLKV
  AfIP-1B-27066   (88)   NATASEYKSIKVSYNISMISGIEYIDFDNLTVEDVLNSLSAGPKNLSLKV
  AfIP-1B-33585   (88)   NATASEYKSIKVSYNISMISGIEYIDFDNLTVEDVLNSLSAGPKNLSLKV
  SLIN6117        (101)  KSSASSSSSINLNYNVQLLAGVEYIDFDRLSPETLLNALKNGPRYRALAA
  FGTW-52         (88)   NATASADKSIKLSYNISMISGIEYIDFDSLTAEDILNSLKPGPKSLVVDV

                          151                                             200
  AfIP-1B-32      (138)  LEKFIAARDCSGSS--------------IEKDELMKEWVKSLQNFISSYG
  AfIP-1B-15554   (138)  LEKFIAVRDCFGSS--------------IEKDELMKEWVKSLQNFISSYG
  AfIP-1B-27066   (138)  LEKFIAARDCSGSS--------------TEKDELMKEWVKSLQNFISSYG
  AfIP-1B-33585   (138)  LEKFIAARDCTGSS--------------TEKDELMKEWVKSLQNFISSYG
  SLIN6117        (151)  LTKFLDVKKAIQNRN--LVEALKDPAQKEKIERVLAGWHNARENFFKQDG
  FGTW-52         (138)  LEKFNTLRDYQQENNLSLFDNNMSFIQDARQDELVQDWLKALNYFYQTYA

                          201                                             250
  AfIP-1B-32      (174)  DGLVVGAIWGGMGSVSTEMTSKKTEDSWKYGETAEFSYSGIGSSVSIAQT
  AfIP-1B-15554   (174)  DGLVVGAIWGGMGSVSTEMTSKKTEDSWKYGETAEFSYSGIGSSVSIAQT
  AfIP-1B-27066   (174)  DGLVVGAIWGGMGSVSTEMTSKKSEDSWKYGETAEFSYSGIGSSVSIAQT
  AfIP-1B-33585   (174)  DGLVVGAIWGGMGSVSTEMTSKKSEDSWKYGETAEFSYSGIGSSVSIAQT
  SLIN6117        (199)  DGLVVGVMWGGLGTVSLQIDNTSGQSNWKYGGRGNFSYAGINGSVSVEAA
  FGTW-52         (188)  DGMVVGVIWGGIGGVSMDIGRSSYEKNWTYGGQADFTYSGTGAAVSVAAT

                          251                                             300
  AfIP-1B-32      (224)  YNGSQKDQSSEVEVSCKALASGGCVESQVNSWFDVVANKSFAEISGISLL
  AfIP-1B-15554   (224)  YNGSQKDQSSEVEVSCKALASGGCVESQVNSWFDVVANKSFAEISGISLL
  AfIP-1B-27066   (224)  YNGSQKDQSSEVEVSCKALASGGCVESQVNSWFDVVANKSFAEISGISLL
  AfIP-1B-33585   (224)  YNGSQKDQSSEVEVSCKALASGGCVESQVNSWFDVVANKSFAEISGISLL
  SLIN6117        (249)  YDGSQQRKNTDVKVSCSSVAMGGCISQQIADWEKKFTNLGFDKLADAKLL
  FGTW-52         (238)  YNGKQSDKGTSVDVSCSSFSSGTCVVNQVNEWFKVVENKAYSEITDLKLL
```

Fig. 2B

```
                             301                                               350
  AfIP-1B-32    (274) DKAPMQSSVSPPPKIPDFLKPEKNAEITEKLDTIKKLGDSEEFALASGYE
AfIP-1B-15554   (274) DKAPMQSSVSPPPKIPDFLKPEKNAEITEKLDTIKKLGDSEEFALASGYE
AfIP-1B-27066   (274) DKAPMQSSVSPPPKIPDFLKPEKNEGVTEKLDTIKKLGDSEEFSLASGYE
AfIP-1B-33585   (274) DKAPMQSSVSPPPKIPDFLKPEKNEEVTEKLDTIKNLGNSEEFSLASGYE
     SLIN6117   (299) DSAPGIDTLNTTPTAPAFVEPTKDKGIAARIEAIRDLNGLEAFAIASAYD
      FGTW-52   (288) DSAPAQGGVKPPPPLPPFVVPKKDPAIEHKLAKIGRLGNTEELSIMSGYD

                      351                                               400
  AfIP-1B-32    (324) EAKKTNPN--LTFEEFKSTVRDKNNIDGLNELASKVQENSLDVLAEGSIS
AfIP-1B-15554   (324) EAKKTNPN--LTFEEFKSTVRDKNNIDGLNELASKVQENSLDVLAEGSIS
AfIP-1B-27066   (324) EAKKTNPN--LTFEEFKSTVRDKNNIDGLNDLASKVQENSLDVLAEGSVS
AfIP-1B-33585   (324) EAKKTNPN--LTFEEFKSTVRDKNNIDGLNDLASKVQENSLDVLAEGSVS
     SLIN6117   (349) KASKDPKNKDLTLAQFIDQTKKPADTRAVDELTSNAANNDIDVLTTSGLE
      FGTW-52   (338) KAKKDDSS--MTPEKFKEKTRQRNSLDKLTELEIKLKGNQLDVLLDINKV

                      401                                               450
  AfIP-1B-32    (372) RRNKNL----SLQGVRTISLDSSSDYAVLGAWIANWSDIFPWMSMGYMNE
AfIP-1B-15554   (372) RRNKNL----SLQGVRTISLDSSSDYAVLGAWIANWSDIFPWMSMGYMNE
AfIP-1B-27066   (372) RRKKNI----SLQGVRASSLDSSSDYAVLGAWIANWSDIFPWMSMGYMNE
AfIP-1B-33585   (372) RRKKNI----SLQGVRASSLDSSSDYAVLGAWIANWSDIFPWMSMGYMNE
     SLIN6117   (399) AGLEEESLLPPDDISEPALTRTADDFTVLGVWIANWADLFPWLATGYLNE
      FGTW-52   (386) ISVE------SPSFEPIAMADNHSGFVPLGVWIVNWADIFPWLSTGYLND

                      451                                               500
  AfIP-1B-32    (418) ISDAEVAEYILKIRCMMQDLSTLNTIYNTFNACNIKLDFC-HLNSASQVA
AfIP-1B-15554   (418) INDAEVAEYILKIRCMMQDLSTLNTIYNTFNACNIKLDFC-HLNSASQVA
AfIP-1B-27066   (418) INDAEVAEYILKIRCMMQDLSTLNTIYNTFNACNIKLDFC-HLNSASQVA
AfIP-1B-33585   (418) INDAEVAEYILKIRCMMQDLSTLNTIYNTFNACNIKLDFC-HLNSASQVA
     SLIN6117   (449) VSTVEAAQQILAKQCMIQDLLTLTRLYRTLASTGLKYEQLGITAPFDQIA
      FGTW-52   (430) ISDTAAAELALKKRCMMQDFCTLSSIYNTFHSSGIKNEG--KLDAPDQIA

                      501                                               550
  AfIP-1B-32    (467) DSFKIAQGVLSDNVESDDAVEIAFNSLSDEAKKIYTAWNEIGFLRNAELG
AfIP-1B-15554   (467) DSFKIAQGVLSDNVESDDAVEIAFNSLSDEAKKIYTAWNEIGFLRNAELG
AfIP-1B-27066   (467) DSFKIAQGVLSDNVESDDAVEIAFNSLSDEAKKIYTAWNEIGFLRNAELG
AfIP-1B-33585   (467) DSFKIAQGVLSDNVESDDAVEIAFNSLSDEAKKIYTAWNEIGFLRNAELG
     SLIN6117   (499) NSFSQEYSWLKDNLDKNNAVRQSYGQLGIQAKAIYGFWNTYGFLRGAELG
      FGTW-52   (478) NAFSNALTILKDNQDQDNVIQQAYDRLGSDAQGIYKIWNHNGFLRNAELG

                      551                                               600
  AfIP-1B-32    (517) LGLLIG-DQSVSSEIIDVKPIPYPEVTYKAAYCSYG---NNNPTAFSSFI
AfIP-1B-15554   (517) LGLLIG-DQSVSSEIIDVKPIPYPEVTYKAAYCSYG---NNNPTAFSSFI
AfIP-1B-27066   (517) LGLLIG-DQSVSSEIIDVKPIPYPEVTYKAAYCSYG---SNNPTAFSSFI
AfIP-1B-33585   (517) LGLLIG-DQSVSSEIIDVKPIPYPEVTYKAAYCSYG---SNNPTAFSSFI
     SLIN6117   (549) LGLMLDDKSLTTTISKQEVADDFICQTYTLESCTFVTDTKTNYSGFASFL
      FGTW-52   (528) FGLMFDTNRSISSTVDRVKGVPHPEVVYKSEYCSFD---KVNYHAFAKSM
```

Fig. 2C

```
                             601                                              650
     AfIP-1B-32     (563)   KMLPFIDTNGDIYAFGPSLMLLRKALPEKMIFTKGGEMAMKLTADKDTGI
     AfIP-1B-15554  (563)   KMLPFIDTNGDIYAFGPSLMLLRKALPEKMIFTKGGEMAMKLTADKDTGI
     AfIP-1B-27066  (563)   KMLPFIDTNGDIYAFGPSLMLLRKALPEKMIFTKGGEMAMKLTADKDKGI
     AfIP-1B-33585  (563)   KMLPFIDTNGDIYAFGPSLMLLRKALPEKMIFTKGGEMAIKLTADKDKGI
     SLIN6117       (599)   KLLPFITPDGKVYVFGPANMLVSEVTDEGIVLSKNPAKAMAFTADTTNKL
     FGTW-52        (575)   KVLPIIDLGGNVYAFGPSAMLLKNTINNEVTFTKSVLTAMRFEIDKDNKI

                             651                                              700
     AfIP-1B-32     (613)   LTNDSVKLIPIPYSAAKGI-QWRGQGQGRSLASSQSLQDQFAALEKELGN
     AfIP-1B-15554  (613)   LTNDSVKLIPIPYSAAKGI-QWRGQGQGRSLASSQSLQDQFAALEKELGN
     AfIP-1B-27066  (613)   LTNDSVRLIPIPYSAAKGV-QWRGQGQGRSLASSQSLQDQFAALEKELGN
     AfIP-1B-33585  (613)   LTNDSVRLIPIPYSAAKGV-QWRGQGQGRSLASSQSLQDQFAALEKELGN
     SLIN6117       (649)   LTNGNLKLYPIPFSGAEGVREWMGQSVSTNLASSITLKKRLNNVKDQLTE
     FGTW-52        (625)   LKNSTTKLYPIPCSAAKGINDWKGPGVGINLSSSKSLSDQLEALRNELLK

                             701                                          747
     AfIP-1B-32     (662)   LNICTLSSDSWSKDWTYTVPYTLRKISTTYIGTVEKINSIFG-----
     AfIP-1B-15554  (662)   LNICTLSSDSWSKDWTYTVPYTLRKISTTYI----------------
     AfIP-1B-27066  (662)   LNICTLSSDSWSKDWTYTVPYT-------------------------
     AfIP-1B-33585  (662)   LNICTLSSDSWSKDWTYTVPYTLRKISTTY-----------------
     SLIN6117       (699)   LSTYSFSSDNWNNDANAQAPYSIRLIKTQYVGLMEAAQSVFNGKPHP
     FGTW-52        (675)   LNSCSVSSDKWNPVWQYTDPYHLKEMGTSYIGLVNKTAKTIFP----
```

Fig. 3A

```
                                     1                                                50
GI_115390458_A_terreus          (1)  -------------------------------------MDDSQWVSIHIRD
GI_67522192_A_nidulans          (1)  --------------------------------------------------
GI_145256342_A_niger            (1)  --------------------------------MPAAGPMDDQWVSFHIRD
GI_169785219_A_oryzae           (1)  -------------------------------MDTDLNKYNSKWVEFHIRD
GI_119487614_N_fischeri         (1)  ----------------------------------MASTTGQQYLDIEIKD
GI_121709507_A_clavatus         (1)  ----------------------------------MAPTSAHQYLDMEIKD
GI_169772307_A_oryzae           (1)  ----------------------------------MPADAYGQYVDIKIED
GI_169777319_A_oryzae           (1)  -----------------------------------MALCLCQQSKISGAQ
GI_152985646_P_aeruginosa       (1)  -------------------------------------------MKYVVSN
GI_15595320_P_aeruginosa        (1)  -----------------------------------MAYAEWIAVKYVVSK
GI_2292820_C_bifermentans       (1)  -------------------MNNNCEVNCENTEENKSNRAYRQWVKFHIEA
GI_2292821_C_bifermentans       (1)  -------------------MNNNCEVNCENTEENKSNRAYRQWVKFHIEA
AfIP-1A-31                      (1)  ------------------------MTAKDIATEESKIRAYAQWIEITIFV
AfIP-1A-15554                   (1)  ------------------------MTAKDIATEESKIRAYAQWIEITIFV
AfIP-1A-27066                   (1)  ------------------------MTAKDIATEESKIRAYAQWIEITIFV
AfIP-1A-33585                   (1)  ------------------------MTAKDIATEESKVRAYAQWIEITIFV
SLIN6118                        (1)  -------------------------------------MAYSEWVEIRIYS
FGTW-51                         (1)  ------------------------------MDLNVEVQAQSQWVEIEIFS
GI_186897694_H_annosum          (1)  -------------------------------------MAYAQWVIIIIRN
GI_54312022_P_ostreatus_p       (1)  -------------------------------------MAYAQWVIIIIHN
GI_60461919_P_ostretus_o        (1)  --------------------------------------AYAQWVIILIHN
GI_238581050_M_perniciosa       (1)  -------------------------------------MAYAQWVVIVLHN
GI_24636240_A_aegerita_A        (1)  ------------------------------MDSNKDERAYAQWVIIILHN
GI_90639437_T_versicolor        (1)  MNFELAHPSRPIAEGICVTEDVRTSEDFVVSDNDDRHRAYAQWVSIEIIN
GI_145230219_A_niger            (1)  ----------------------------------MAERAEAQWVHIRVVN
GI_70985747_A_fumigatus_h       (1)  ---------------------------------MASVQAYAQWVTVHLIN
GI_158524422_R_australe         (1)  --------------------------------------------------
GI_26112720_B_vulgaris          (1)  -------------------------------------MAYAQWVVVHIIN
GI_46507636_L_multiflorum       (1)  -------------------------------------MAYAQWVVIHIIN

                                     51                                              100
GI_115390458_A_terreus         (14)  RLAQGNITIRESFLYDCSRSGLPLLFRGQKHSPEDEKKALTEDDIDQLII
GI_67522192_A_nidulans          (1)  -----------------------------------------------MTI
GI_145256342_A_niger           (19)  HLEKGEITVRHTVIEGG-----------EFHDPNNRRQSLTEDEIDEITI
GI_169785219_A_oryzae          (20)  HLKDGEISVRHTVIEDG-----------EFQDPNNRRKSIHEDVIDEIVI
GI_119487614_N_fischeri        (17)  DMKYD-IRIENAHIESG-----------EFYREGDQNDTLTTDDIEDMII
GI_121709507_A_clavatus        (17)  DMQYD-IRIEKARIDSG-----------EFHSASDENDTLTTDDVEDLMI
GI_169772307_A_oryzae          (17)  GMKYD-LRIENAHLDSG-----------QFYRQGDQGDIMTADDIDDMII
GI_169777319_A_oryzae          (16)  ELIRLLFDIDLLHLLIDLNIR-----SRKIPKGNMKRTKKYASQVNGKEI
GI_152985646_P_aeruginosa       (8)  SIGT--AGIRNATLQWG-----------MFCRCSNKEDEISAEKDSSMNV
GI_15595320_P_aeruginosa       (16)  SIGT--VGIRNATLQWG-----------KFYRYTNKDDEISTEEVSSMNV
GI_2292820_C_bif               (32)  VNEG--LKIRNASLKWG-----------KFHDPNNKDIPISPEDISKINI
GI_2292821_C_bif               (32)  VHSN--LKIRNASLTWG-----------KFHDPYNKEIPISPEDISKINI
AfIP-1A-31                     (27)  VNSN--FKVEGAYLRWG-----------KFHVPGDKDKEISPSQINGTII
AfIP-1A-15554                  (27)  VNSN--FKVEGAYLRWG-----------KFHVPGDKDKEISPSQINGTII
AfIP-1A-27066                  (27)  VNSN--FKVEGAYLKWG-----------KFHVPGDKDKEITPSQINGTII
AfIP-1A-33585                  (27)  VNSN--FKVEGAYLKWG-----------KFHVPGDKDKEITPSQINGTII
SLIN6118                       (14)  ENME--IKIKNIKLNWG-----------KFYEGPNQDIKITAPVLSDAVI
FGTW-51                        (21)  ENMD--IEIKKAELLWG-----------KFHKPGNKSNEISSDTVNKTKI
GI_186897694_H_annosum         (14)  VGAAK-FSIKNLNPSWG-----------KLHAEGDKDTEVNKSTIEGKVV
GI_54312022_P_ostreatus        (14)  VGSKD-VKIKNLKPSWG-----------KLHADGDKDTEVSASKYEGTVI
GI_60461919_P_ostretus         (13)  VGQQN-VKIKNLNASWG-----------KLYADGDKETEVPASKYEGMVI
GI_238581050_M_per             (14)  VGNSP-MKVKNVSLDWG-----------KFHVDGNKDKEIGKDQIEGKVI
GI_24636240_A_aegerita         (21)  VGSSP-FKIANLGLSWG-----------KLYADGNKDKEVYPSDYNGKTV
GI_90639437_T_ver              (51)  YGPRP-VKIKNVYRSWG-----------KLYIEGNKDKEVSPSYFENTTI
GI_145230219_A_niger           (17)  SLSFDTLSVRNTWLGWG-----------KFHKENNKSAEIPVSDINALRA
GI_70985747_A_funigatus_h      (18)  SMSSETLSIQNASLSWG-----------KWYKDGDKDAEITSEDVQQKTA
GI_158524422_R_australe         (1)  -----------------------------------KDEIISANEVNQLRI
GI_26112720_B_vulgaris         (14)  SFRNGTISIKDAKAFWG-----------KFYKNGNKDDEIIANEVNQLMI
GI_46507636_L_multiflorum      (14)  SFRNGSISIKNAEAMWG-----------KFHKNGNKEAKIGAGEVNKMSV
```

Fig. 3B

| | | |
|---|---|---|
| | | 101 150 |
| GI_115390458_A_terreus | (64) | PS-EGIGEVCARGRR----GSEGWMDLFDG---EKKICELHWDNRTKRPS |
| GI_67522192_A_nidulans | (4) | PA-EGLGEVCATGRR----GSEGWLDLFDG---DKKICELHWDNRAERRW |
| GI_145256342_A_niger | (58) | PS-YGIGEICARGRR----GSEGRLDLFHD---EEKICELHWDNRQGNPV |
| GI_169785219_A_oryzae | (59) | PS-DGIGEICAHGRR----GSEGRLDLFHG---NDKICELHWDDRDGRRE |
| GI_119487614_N_fischeri | (55) | RHNGGLRHVCSGGEEKGFKGLQGTIDLIDDVK-DARICTLAWNAPMEPGK |
| GI_121709507_A_clavatus | (55) | RHNGGTRHVCSSGEEEGFKGLQGTIDLVDDVR-DARICTLAWNAPMEPGK |
| GI_169772307_A_oryzae | (55) | RHNGGIREVCSQGETDGMSGTQGTIDLIDDVK-DTRICTLAWSAPMQGGR |
| GI_169777319_A_oryzae | (61) | IP-GTSQLLETCGASSAASGTEGTLELNDK---TQRICKDYWDCPNGGKV |
| GI_152985646_P_aerugin | (45) | QA-GSPQWIASGGRENAASGTRGCFDCHDG---NTKMGTFSWDDPRKGGA |
| GI_15595320_P_aeruginosa | (53) | QA-GSPQWIASGGRENASSGTQGSFDCYDG---NTKMGTFSWDDPWKSGA |
| GI_2292820_C_bif | (69) | EK-HDTAIIASSGKENTASGTEGVFYICDEN--EDKIAAIYWDCPWSGSN |
| GI_2292821_C_bif | (69) | GI-GRIEIIASSGKENTASGTEGVFYICDEH--EEKIVTYYWDCPNSGSN |
| AfIP-1A-31 | (64) | KD-EDSYTIASGGRENASSGTEGGFSLYDG---DKLVFEYYWDCPNSGSN |
| AfIP-1A-15554 | (64) | KD-EDSYTIASGGRENASSGTEGGFSLYDG---DKLVFEYYWDCPWSGSN |
| AfIP-1A-27066 | (64) | KD-EDSYTIASGGRENASSGTEGGFSLYDG---DKLVFEYYWDCPNSGSN |
| AfIP-1A-33585 | (64) | KD-EDSYTIASGGRENASSGTEGGFSLYDG---DKLVFEYYWDCPNSGSN |
| SLIN6118 | (51) | KS-GEKYTVWSGGRDGASSGTEGSFELYDG---DTQVARFGWICPWSGAN |
| FGTW-51 | (58) | SS-GTKSKIASGGRADTSSGTEGKFEIYHD---DKWLATYKWDCPWAGSN |
| GI_186897694_H_annosum | (52) | EA-DQQLRINAGGRSDAAEGTTGSFDLVDVAT-QQVIRHVYWDCPNGTKR |
| GI_54312022_P_ostreatus | (52) | KP-DEKLQINAGGRSDAAEGTTGTFDLVDPADGDKQVRHFYWDCPWGSKT |
| GI_60461919_P_ostretus | (51) | AP-GDQVQINAGGREDAAEGTTGTKDLVDPNDSDKQVRHISWDCPWGTKA |
| GI_238581050_M_pern | (52) | GP-DEKFQINSGGRSDASSGTEGSFDLVDTKDGDKTIRHCYWECPWGSKT |
| GI_24636240_A_aegerita | (59) | GP-DEKIQINSGGRENASSGTEGSFDIVDPNDGNKTIRHFYWECPNGSKR |
| GI_90639437_T_versicolor | (89) | NP-NGTLTIAGGGRSNASSGTEGGFNIVDPSRGDDIIRSVYWDCPWGSKT |
| GI_145230219_A_niger | (56) | AP-GGSFNVFAGGRAHSPSGTEGSFDVYNG---DVEVAYIYWDCPWGSKR |
| GI_70985747_A_funigatus | (57) | PP-GGSVNVNSGGRSDAASGTTGGFDLYDG---NTKIGRVHWDCPNGAKT |
| GI_158524422_R_australe | (16) | PA-GSDGDIASSGRSDSASGTEGQVDIYDG---DTKVCTLYWSCPWGSKA |
| GI_26112720_B_vulgaris | (53) | PA-GSDGDIASGGRSDGASGTEGQVYVYDG---DTKVCTLYWSCPWGSKA |
| GI_46507636_L_multiflo | (53) | GA-GSSEKVSSGGRSDSASGTEGKFDIYDG---DNAVCTVYWSCPWGSKS |

| | | |
|---|---|---|
| | | 151 200 |
| GI_115390458_A_terreus | (106) | N-EFEVIDGDKD-YKIKCSGWSPQAG-PLGHVFIDISAAKKKAAAAAAAK |
| GI_67522192_A_nidulans | (46) | N-DFEVLEPDEG-YRVECSGWSSER-GPLGHVFVDVSEARKEELRREKEL |
| GI_145256342_A_niger | (100) | N-IVEMLDSNSK-YRVEHGGWSPEAG-PLGHVYIDILEQQKKKNSK---- |
| GI_169785219_A_oryzae | (101) | N-LVEMLDESDK-YRIEHGGWSPEANGPLGHVYVDVWAKDKSK------- |
| GI_119487614_N_fischeri | (104) | R-NTFMLRDQDPRYNINIGKWNESG--ILGRVPVTISDE----------- |
| GI_121709507_A_clavatus | (104) | R-NLLMMHHHDPQYNVEIGKWNESG--VMGTVPITISNQ----------- |
| GI_169772307_A_oryzae | (104) | K-NRFSMLNHDPRYKVRIGKWQESG--TMGTVNVAIKDE----------- |
| GI_169777319_A_oryzae | (107) | N-KFKVQEKYKT-YRVKVGPWKSYG-GALGNVDVEISRKRA--------- |
| GI_152985646_P_aerug | (91) | TQTRHFTPASQN-YAGISSGGNATG-AASARSP---------------- |
| GI_15595320_P_aerugin | (99) | TNTRSFTPASAD-YAGITSGGNATG-TDIGEVTLTLGRFS---------- |
| GI_2292820_C_bif | (116) | --KLTIDKYNTK-FAIKQSPTMISSSGAIGDVNGKVSKIWA--------- |
| GI_2292821_C_bif | (116) | --KFEIRDKNPN-FIIETYPTMISSSGAIGDVNIRVFRRF---------- |
| AfIP-1A-31 | (110) | SDELTVKDKEN--YTVIKKGGGSPS-GATGNIFITVVKKS---------- |
| AfIP-1A-15554 | (110) | SDELTVKDKEN--YTVIKKGGGSPS-GATGNIFITVVKKS---------- |
| AfIP-1A-27066 | (110) | SDELTVKDKEN--YTVSKKGGGSPS-GATGNIFITVVKKS---------- |
| AfIP-1A-33585 | (110) | SDELTVKDKEN--YTVSKKGGGSPS-GATGNIFITVVKKS---------- |
| SLIN6118 | (97) | SCSLIPGEQENKLYKTARQWSGLTS-GPLGTITLSCVKLL---------- |
| FGTW-51 | (104) | SHSLSVTQDND--YKIRKEGGKISD-GALGNIRITCIKVG---------- |
| GI_186897694_H_annosum | (100) | N-TFTVSGSNSK-WMIEYSGQNLDS-GALGTISV---------------- |
| GI_54312022_P_ostreatus | (101) | N-TNTVSGSNTK-WMIEYSGQNLDS-GALGTITVDTLKKGN--------- |
| GI_60461919_P_ostretus | (100) | N-SKVVGGSNSK-WMIEYTGQKLDS-GALGTITVNTLKIGN--------- |
| GI_238581050_M_pern | (101) | N-TWTVNGSNSK-WMVEHQGAKLYG-GALGTITVDAMKKGN--------- |
| GI_24636240_A_aegerita | (108) | N-TWTPSGSNTK-WMVEWSGQNLDS-GALGTITVDVLRKGN--------- |
| GI_90639437_T_versicolor | (138) | N-KNSVSGSLSG-KDVYDKGANIDS-GALGNITIETVYKG---------- |
| GI_145230219_A_niger | (102) | N-QFRVDRIADD-YWVKTGYWKQSG-GAIGSVTVEIGRRDRAIRSSL--- |
| GI_70985747_A_funigatus | (103) | N-DFDVGERNKN-YWVKIGTWKKYG-GAIGTVDVEVGRKR---------- |
| GI_158524422_R_australe | (62) | N-DFQIRNINRD-YGITLGDWNRDS-GALGKVDVDIFSLWLEDVLGKKLW |
| GI_26112720_B_vulgaris | (99) | N-NFHIRNINKD-YGITPSDWKSDS-GALGRVNVDI-------------- |
| GI_46507636_L_multiflo | (99) | N-NFQIQNRNKD-YGITLGDWKQDS-GALGEVDVDISRKG---------- |

Fig. 3C

| | | 201 244 |
|---|---|---|
| GI_115390458_A_terreus | (153) | -------------------------------------------- |
| GI_67522192_A_nidulans | (93) | GGLRVFEGPGVGEKSVDVDVAEEVPVLGGLGGIGGNITMGGFIS |
| GI_145256342_A_niger | (143) | -------------------------------------------- |
| GI_169785219_A_oryzae | (142) | -------------------------------------------- |
| GI_119487614_N_fischeri | (140) | -------------------------------------------- |
| GI_121709507_A_clavatus | (140) | -------------------------------------------- |
| GI_169772307_A_oryzae | (140) | -------------------------------------------- |
| GI_169777319_A_oryzae | (145) | -------------------------------------------- |
| GI_152985646_P_aer | (122) | -------------------------------------------- |
| GI_15595320_P_aer | (137) | -------------------------------------------- |
| GI_2292820_C_bif s | (154) | -------------------------------------------- |
| GI_2292821_C_bif | (153) | -------------------------------------------- |
| AfIP-1A-31 | (147) | -------------------------------------------- |
| AfIP-1A-15554 | (147) | -------------------------------------------- |
| AfIP-1A-27066 | (147) | -------------------------------------------- |
| AfIP-1A-33585 | (147) | -------------------------------------------- |
| SLIN6118 | (136) | -------------------------------------------- |
| FGTW-51 | (141) | -------------------------------------------- |
| GI_186897694_H_annosum | (131) | -------------------------------------------- |
| GI_54312022_P_ostreatus | (139) | -------------------------------------------- |
| GI_60461919_P_ostretus | (138) | -------------------------------------------- |
| GI_238581050_M_pern | (139) | -------------------------------------------- |
| GI_24636240_A_aegerita | (146) | -------------------------------------------- |
| GI_90639437_T_vers | (175) | -------------------------------------------- |
| GI_145230219_A_niger | (146) | -------------------------------------------- |
| GI_70985747_A_funigatus | (140) | -------------------------------------------- |
| GI_158524422_R_australe | (109) | LQSRSKLT------------------------------------ |
| GI_26112720_B_vulgaris | (132) | -------------------------------------------- |
| GI_46507636_L_multi | (136) | -------------------------------------------- |

Fig. 4

```
                  1                                                50
AfIP-1B-32   (1)  MDIEAKSINPLMGITVGSTVLGNDFKPSVLINPITRMITQKEIEMGMSGK
  FGTW-52    (1)  MKTQIEIVNPFAGVKIGSYVSGNQFSPSVITGDITRMEEVLEVQKYISGK

                  51                                              100
AfIP-1B-32  (51)  SQYVYTDSLNEGTIGFSGAYGPSGIAKFTSAVAVSVSNATASEYKSIKVS
  FGTW-52   (51)  SNYVYSDKLNEASLGVSGAYGVTGVSKLTSSVSAHAGNATASADKSIKLS

                  101                                             150
AfIP-1B-32 (101)  YNISMISGIEYIDFDNLTVEDVLNSLSAGPKNLSLKVLEKFIAARDCSGS
  FGTW-52  (101)  YNISMISGIEYIDFDSLTAEDILNSLKPGPKSLVVDVLDKFNTLRDYQQE

                 151                                             200
AfIP-1B-32 (151)  S--------------IEKDELMKEWVKSLQNFISNYGDGLVVGAIWGGMG
  FGTW-52  (151)  NNLSLFDNNMSFIQDARQDELVQDWLKALNYFYQTYADGNVVGVIWGGIG

                  201                                             250
AfIP-1B-32 (187)  SVSTEMTSKKTEDSWKYGETAEFSYSGIGSSVSIAQTYNGSQKDQSSEVE
  FGTW-52  (201)  GVSMDIGRSSYEKNWTYGGQADFTYSGTGAAVSVAATYNGKQSDKGTSVD

                  251                                             300
AfIP-1B-32 (237)  VSCKALASGGCVESQVNSWFDVVANKSFAEISGISLLDKAPMQSSVSPPP
  FGTW-52  (251)  VSCSSFSSGTCVVNQVNEWFKVVENKAYSEITDLKLLDSAPAQGGVKPPP

                  301                                             350
AfIP-1B-32 (287)  KIPDFLKPEKNAEITEKLDTIKKLGDSEEFALASGYKEAKKTNPNLTFEE
  FGTW-52  (301)  PLPPFVVPKKDPAIEHKLAKIGRLGNTEELSIMSGYDKAKKDDSSMTPEK

                  351                                             400
AfIP-1B-32 (337)  FKSTVRDKNNIDGLNELASKVQENSLDVLAEGSISRRNKNLSLQGVRTIS
  FGTW-52  (351)  FKEKTRQRNSLDKLTELEIKLKGNQLDVLLDINKVISVE--SPSFEPIAM

                  401                                             450
AfIP-1B-32 (387)  LDSSSDYAVLGAWIANWSDIFPWMSMGYMNEISDAEVAEYILKIRCMMQD
  FGTW-52  (399)  ADNHSGFVPLGVWIVNWADIFPWLSTGYLNDISDTAAAELALKKRCMMQD

                  451                                             500
AfIP-1B-32 (437)  LSTLNTIYNTFNACNIKLDFCHLNSASQVADSFKIAQGVLSDNVESDDAV
  FGTW-52  (449)  FCTLSSIYNTFHSSGIKMEG-KLDAPDQIANAFSNALTILKDNQDQDNVI

                  501                                             550
AfIP-1B-32 (487)  EIAFNSLSDEAKKIYTAWNEIGFLRNAELGLGLLIG-DQSVSSEIIDVKP
  FGTW-52  (498)  QQAYDRLGSDAQGIYKIWNHNGFLRNAELGFGLNFDTNRSISSTVDRVKG

                  551                                             600
AfIP-1B-32 (536)  IPIPEVTYKAAYCSYGNNNPTAFSSFIKNLPFIDTNGDIYAFGPSLMLLK
  FGTW-52  (548)  VPHPEVVYKSEYCSFDKVNYHAFAKSMKVLPIIDLGGNVYAFGPSAMLLK

                  601                                             650
AfIP-1B-32 (586)  KALPEKMIFTKGGEMAMKLTADKDTGILTNDSVKLIPIPYSAAKGI-QWK
  FGTW-52  (598)  NTINNEVTFTKSVLTAMKFEIDKDNKILKNSTTKLYPIPCSAAKGINDWK

                  651                                             700
AfIP-1B-32 (635)  GQGQGRSLASSQSLQDQFAALEKELGNLNICTLSSDSWSKDWTYTVPYTL
  FGTW-52  (648)  GPGVGINLSSSKSLSDQLEALRNELLKLNSCSVSSDKWNPVWQYTDPYHL

                  701               720
AfIP-1B-32 (685)  RKISTTYIGTVEKINSIFG-
  FGTW-52  (698)  KEMGTSYIGLVNKTAKTIFP
```

Fig. 5

```
                               101                                               150
GI_49175503_Bt_Cry34A_  (1)    ---------------------------------------INNKTRHTLQL
   Cry34Aa2_AAK64560    (1)    ------------------------------MSAREVHIEIKNKTRHTLQL
   Cry34Ba1_AAK64566  (101)    IIENNNGKILTAGTGQSLGLLYLTDEIPEDSNQQWNLTSIQTISLPSQPI
          AfIP-1A-31    (1)    ------------------MTAKDIATEESKIRAYAQWIEITIFVVNSNFK
            SLIN6118    (1)    -------------------------------MAYSEWVEIRIYSENMEIK
             FGTW-51    (1)    ------------------------MDLNVEVQAQSQWVEIEIFSENMDIE
   Cry34Ac2_AAK64562    (1)    ------------------------------MSAREVHINVNNKTGHTLQL
   Cry34Ac1_AAG50118    (1)    ------------------------------MSAREVHIDVNNKTGHTLQL
   Cry34Ab1_AAG41671    (1)    ------------------------------MSAREVHIDVNNKTGHTLQL

                               151                                               200
GI_49175503_Bt_Cry34A  (12)    EDKTKLTSGRWRTSPTN-------------------VARDTIKTFVAES-
   Cry34Aa2_AAK64560   (21)    EDKTKLSGGRWRTSPTN-------------------VARDTIKTFVAES-
   Cry34Ba1_AAK64566  (151)    IDTTLVDYPKYSTTGSINYNGTALQLMGWTLIPCIMVYDKTIASTHTQIT
          AfIP-1A-31   (33)    VSGAYLRWGKFHVPGDKDKE----------------ISPSQINGTTIKDE
            SLIN6118   (20)    IKNIKLNWGKFYEGPNQDIE----------------FTAPVLSDAVIKSG
             FGTW-51   (27)    IKKAELLWGKFHKPGNKSNE----------------ISSDTVNKTKISSG
   Cry34Ac2_AAK64562   (21)    EDKTKLDGGRWRTSPTN-------------------VANDQIKTFVAES-
   Cry34Ac1_AAG50118   (21)    EDKTKLDGGRWRTSPTN-------------------VANDQIKTFVAES-
   Cry34Ab1_AAG41671   (21)    EDKTKLDGGRWRTSPTN-------------------VANDQIKTFVAES-

                               201                                               250
GI_49175503_Bt_Cry34A  (42)    ----------HGFMTGIEGIIYFSVNGEAEISLHFDNPYVGSN---KYDG
   Cry34Aa2_AAK64560   (51)    ----------HGFMTGVEGIIYFSVNGDAEISLHFDNPYIGSN---KCDG
   Cry34Ba1_AAK64566  (201)    TTPYYILKKYQRWVLATGSGLSVPAHVKSTFEYEWGTDTDQKTSVINTLG
          AfIP-1A-31   (67)    DSYTIASCGRENASSGTEGGFSLYDGDKLVFEYYWDCPWSGSNSDELTVK
            SLIN6118   (54)    EKYTVWSCGRDGASSGTEGSFELYDGDTQVARFGWICPWSGANSCSLIPG
             FGTW-51   (61)    TKSKIASCGRADTSSGTEGKFEIYHDDKWLATYKWDCPWAGSNSHSLSVT
   Cry34Ac2_AAK64562   (51)    ----------HGFMTGTEGHIYYSINGEAEISLYFDNPYSGSN---KYDG
   Cry34Ac1_AAG50118   (51)    ----------HGFMTGTEGTIYYSINGEAEISLYFDNPYSGSN---KYDG
   Cry34Ab1_AAG41671   (51)    ----------NGFMTGTEGTIYYSINGEAEISLYFDNPFAGSN---KYDG

                               251                                               300
GI_49175503_Bt_Cry34A  (79)    SSDKAAYEVIAQGG---SGDIS----------------------------
   Cry34Aa2_AAK64560   (88)    SSDKPEYEVITQSG---SGDKSHVTYTIQTVSLRL---------------
   Cry34Ba1_AAK64566  (251)    FQINTDTKLKATVPEVGGGTTDIRTQITEELKVEYSSENKEMRKYKQSFD
          AfIP-1A-31  (117)    DKEN--YTVIKKGGGSPSGATGNIFITVVKKS------------------
            SLIN6118  (104)    EQENKLYKTARQWSGLTSGPLGTITLSCVKKL------------------
             FGTW-51  (111)    QDND--YKIDKEGGNISDGALGNIRITCIKVG------------------
   Cry34Ac2_AAK64562   (88)    HSNKPQYEVTTQGG---SGNQSHVTYTIQTASSRYGNNS-----------
   Cry34Ac1_AAG50118   (88)    HSNKNQYEVITQGG---SGNQSHVTYTIQTVSSRYGNNS-----------
   Cry34Ab1_AAG41671   (88)    HSNKSQYEIITQGG---SGNQSHVTYTIQTTSSRYGHKS-----------
```

Fig. 6

```
                         451                                              500
AfIP-1A-31    (1)  ------------------------MTAKDIATEESKIRAYAQWIEIIIFV
   FGTW-51    (1)  ------------------------------MDLNVEVQAQSQWVEIEIFS
  SLIN6118    (1)  -------------------------------------MAYSEWVEIRIYS
     Cry3A  (451)  DSIDQLPPETTDEPLEKGYSHQLNYVMCFLMQGSRGTIPVLTWTHKSVDF

                   501                                              550
AfIP-1A-31   (27)  VNSNFKVEGAYLRWGKFHVPGDKDKEISPSQINGTIIKDED---------
   FGTW-51   (21)  ENMDIEIKKAELLWGKFHKPGNKSNEISSDTVNKTKISSGT---------
  SLIN6118   (14)  ENMEIKIKNIKLNWGKFYEGPNQDIEITAPVLSDAVIKSGE---------
     Cry3A  (501)  FNMIDSKKITQLPLVKAYKLQSGASVVAGPRFTGGDIIQCTENGSAATIY

                   551                                              600
AfIP-1A-31   (68)  -----SYTIASCGRENASSGTEGGFSLYDGDKLVFEYYWDCPWSGSNSDE
   FGTW-51   (62)  -----KSKIASCGRADTSSGTEGKFEIYHDDKWLATYKWDCPWAGSNSHS
  SLIN6118   (55)  -----KYTVWSCGRDGASSGTEGSFELYDGDTQVARFGWICPWSGANSCS
     Cry3A  (551)  VTPDVSYSQKYRARIHYASTSQITFTLSLDGAPFNQYYFDKTINKGDTLT

                   601                                        644
AfIP-1A-31  (113)  LTVKDKEN--YTVIKKGGGSPSGATGNIFITVVKKS--------
   FGTW-51  (107)  LSVTQDND--YKIDKEGGNISDGALGNIRITCIKVG--------
  SLIN6118  (100)  LIPGEQENKLYKTARQWSGLTSGPLGTITLSCVKLL--------
     Cry3A  (601)  YNSFNLASFSTPFSLSGNNLQIGVTGLSAGDKVYIDKIEFIPVN
```

Fig. 7

```
                         1                                                50
AfIP-1B-32     (1)  MDIEAKSINPLMGITVGSTVLGN--DFKPSVLINPITRMITQKEIEMGMS
     Cry3A     (1)  MNPNNRSEHDTIKTTENNEVPTNHVQYPLAETPNPTLEDLNYKEFLRMTA
                    51                                               100
AfIP-1B-32    (49)  GKSQYVYTDSLNEGTIGFSGAYGPSGIAKFTSAVAVSVSNATASEYKSIK
     Cry3A    (51)  DNN----TEALDSSTTKDVIQKGISVVGDLLGVVGFPFGGALVSFYTNFL
                    101                                              150
AfIP-1B-32    (99)  VSYNISMISGIEYIDFDNLTVEDVLNSLSAGPKNLSLKVLEKFIAARDCS
     Cry3A    (97)  NTIWPSEDPWKAFMEQVEALMDQKIADYAKNKALAELQGLQNNVEDYVSA
                    151                                              200
AfIP-1B-32   (149)  GSSIEKDELMKEWVKS-------LQNFISSYGDGLVVGAIWGGMGSVSTE
     Cry3A   (147)  LSSWQKNPVSSRNPHSQGRIRELFSQAESHFRNSMPSFAISGYEVLFLTT
                    201                                              250
AfIP-1B-32   (192)  MTSKKTEDSWKYGETAEFSYSGIGSSVSIAQTYNGSQKDQSSEVEVSCKA
     Cry3A   (197)  YAQAANTHLFLLKDAQIYGEEWGYEKEDIAEFYKR-QLKLTQEYTDHCVK
                    251                                              300
AfIP-1B-32   (242)  LASGGCVESQVNSWFDVVANKSFAEISGISLLDKAPMQSSVSPPPKIPDF
     Cry3A   (246)  WYNVGLDKLRGSSYESWVNFNRYRREMTLTVLDLIALFPLYDVR-----L
                    301                                              350
AfIP-1B-32   (292)  LKPEKNAEITEKLDTIKKLGDSEEFALASGYEEAKKTNPNLTFEEFKSTV
     Cry3A   (291)  YPKEVKTELTRDVLTDPIVGVNNLRGYGT------------TFSNIENYI
                    351                                              400
AfIP-1B-32   (342)  RDKNNIDGLNELASKVQENSLDVLAEGSISRRNKNLSLQGVRTISLDSSS
     Cry3A   (329)  RKPHLFDYLHRIQFHTR------FQPGYYGNDSFNYWSGNYVSTRPSIGS
                    401                                              450
AfIP-1B-32   (392)  DYAVLGAWIANWSDIFPWMSMGYMNEISDAEVAEYILKIRCMMQDLSTLN
     Cry3A   (373)  NDIITSPFYGNKS-SEPVQNLEFNGEKVYRAVAN------------TNLA
                    451                                              500
AfIP-1B-32   (442)  TIYNTFNACNIKLDFCHLNSASQVADSFKIAQGVLSDNVESDDAVEIAFN
     Cry3A   (410)  VWPSAVYSGVTKVEFSQYNDQTDEASTQTYDSKRNVGAVSWDSIDQLPPE
                    501                                              550
AfIP-1B-32   (492)  SLSDEAKKIYTAWNEIGFLRNAELGLGLLIGDQSVSSEIIDVKPIPYPEV
     Cry3A   (460)  TTDEPLEKGYSHQLNYVMCFLMQGSRGTIPVLTWTHKSVDFFNMIDSKKI
                    551                                              600
AfIP-1B-32   (542)  TYKAAYCSYGNNNPTAFSSFIKMLPFIDTNGDIYAFGPSLMLLRKALPEK
     Cry3A   (510)  TQLPLVKAYKLQS-----------GASVVAGPRFTGGDIIQCTENGSAAT
                    601                                              650
AfIP-1B-32   (592)  MIFTKGGEMAMKLTADKDTGILTNDSVKLIPIPYSAAKGIQWKGQGQGRS
     Cry3A   (549)  IYVTPDVSYSQKYRARIHYASTSQITFTLSLDGAPFNQYYFDKTINKGDT
                    651                                              700
AfIP-1B-32   (642)  LAS-SQSLQDQFAALEKELGNLNICTLSSDSWSKDWTYTVPYTLRKISTT
     Cry3A   (599)  LTYNSFNLASFSTPFELSGNNLQIGVTGLSAGDKVYIDKIEFIPVN----
                    701         713
AfIP-1B-32   (691)  YIGTVEKINSIFG
     Cry3A   (645)  -------------
```

Motif 5 Cloning strategy

INSECTICIDAL PROTEINS AND METHODS FOR THEIR USE

CROSS REFERENCE

This utility application claims the benefit U.S. Provisional Application No. 61/675,950, filed Jul. 26, 2012 and U.S. Provisional Application No. 61/739,468, filed Dec. 19, 2012, which are incorporated herein by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "4244_sequence_listing.txt" created on Mar. 7, 2013, and having a size of 1,505 kilobytes and is filed concurrently with the specification. The sequence listing contained in this ASCII formatted document is part of the specification and is herein incorporated by reference in its entirety.

FIELD OF THE INVENTION

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND OF THE INVENTION

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY OF THE INVENTION

Compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding *Alcaligenes* Insecticidal Protein-1A and *Alcaligenes* Insecticidal Protein-1B (AfIP-1A and AfIP-1B) polypeptides including amino acid substitutions, deletions, insertions, and fragments thereof, and combinations thereof. Additionally, amino acid sequences corresponding to the AfIP-1A and AfIP-1B polypeptides are encompassed. Provided are an isolated or recombinant nucleic acid molecule capable of encoding an AfIP-1A polypeptide of SEQ ID NO: 2 as well as amino acid substitutions, deletions, insertions, fragments thereof and combinations thereof. Also provided are an isolated or recombinant nucleic acid molecule capable of encoding an AfIP-1B polypeptide of SEQ ID NO: 4 as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. Also provided are isolated or recombinant AfIP-1A polypeptides of SEQ ID NO: 2 as well as amino acid substitutions, deletions, insertions, fragments thereof and combinations thereof. Also provided are isolated or recombinant AfIP-1B polypeptides of SEQ ID NO: 4 as well as amino acid substitutions, deletions, insertions, fragments thereof and combinations thereof.

Methods are provided for producing the polypeptides and for using those polypeptides for controlling or killing a Lepidopteran, Coleopteran, nematode, fungi, Hemipteran and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

Methods for detecting the nucleic acids and polypeptides of the embodiments in a sample are also included. A kit for detecting the presence of an AfIP-1A and/or AfIP-1B polypeptide or detecting the presence of a nucleotide sequence encoding an AfIP-1A and/or AfIP-1B polypeptide in a sample is provided. The kit may be provided along with all reagents and control samples necessary for carrying out a method for detecting the intended agent, as well as instructions for use.

The compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of AfIP-1A and AfIP-1B polypeptides or nucleic acids in products or organisms.

The following embodiments are encompassed by the present disclosure.

1. A recombinant nucleic acid molecule encoding an AfIP-1A polypeptide.
2. The recombinant nucleic acid molecule of embodiment 1, wherein the AfIP-1A polypeptide is from an *Alcaligenes faecalis* strain.
3. The recombinant nucleic acid molecule of embodiment 2, wherein the *Alcaligenes faecalis* strain is DDMC P4G7 deposited under accession #NRRL B-50625.
4. A recombinant nucleic acid molecule encoding an AfIP-1A polypeptide, wherein the AfIP-1A polypeptide comprises an amino acid motif as represented by positions 100-107 of SEQ ID NO: 257.
5. The recombinant nucleic acid molecule of embodiment 4, wherein the AfIP-1A polypeptide further comprises any one or more amino acid motifs as represented by positions 15-26 of SEQ ID NO: 257, positions 33-53 of SEQ ID NO: 257 and positions 71-84 of SEQ ID NO: 257.
6. A recombinant nucleic acid molecule encoding an AfIP-1A polypeptide, wherein the AfIP-1A polypeptide has at least 80% identity to the amino acid sequence of SEQ ID NO: 2.
7. A recombinant nucleic acid molecule encoding an AfIP-1A polypeptide, wherein the AfIP-1A polypeptide has at least 80% identity to the amino acid sequence of SEQ ID NO: 2 and comprises an amino acid motif as represented by positions 100-107 of SEQ ID NO: 257.
8. The recombinant nucleic acid molecule of embodiment 7, wherein the AfIP-1A polypeptide further comprises any one or more amino acid motifs as represented by positions 15-26 of SEQ ID NO: 257, positions 33-53 of SEQ ID NO: 257, positions 71-84 of SEQ ID NO: 257, and by positions 100-107 of SEQ ID NO: 257.
9. The recombinant nucleic acid molecule of embodiment 6, wherein the AfIP-1A polypeptide comprises an amino acid sequence of SEQ ID NO: 255, wherein Xaa at position 6 is Ile or Thr; Xaa at position 7 is Ala or Val; Xaa at position 9 is Glu or Gly; Xaa at position 13 is Ile or Val; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr or Ala; Xaa at position 24 is Ile or Leu; Xaa at position 30 is Asn or Ser; Xaa at position 33 is Val or Ile; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Leu or Phe; Xaa at position 51 is Lys, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Leu or Phe; Xaa at position 56 is Ser or Leu; Xaa at position 57 is Gln, Glu, Leu or Phe; Xaa at position 58 is Ile, Val, Leu or Phe; Xaa at position 60 is Gly, Leu of Phe; Xaa at position 61 is Thr, Ile or Phe; Xaa at position 62 is Ile, Val, Leu or Phe; Xaa at position 64 is Lys, Glu, Leu or Phe; Xaa at position 65 is Asp, Leu or Phe; Xaa at position 67 is Asp or Glu; Xaa at position 68 is Ser or Thr; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 82 is Gly, Glu, Asn, Trp or Tyr; Xaa at position 96 is Val or Ile; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 111 is Asp or Asn; Xaa at position 113 is Leu or Ser; Xaa at position 115 is Val or Ile; Xaa at position 116 is Lys or Glu; Xaa at position 120 is Asn or Lys; Xaa at position 121 is Tyr, Leu or Phe; Xaa at position 122 is Thr, Leu or Phe; Xaa at position 123 is Val, Leu, Phe or Asn; Xaa at position 124 is Ile, Ser, Leu or Phe; Xaa at position 125 is Lys, Leu, Phe or Met; Xaa at position 126 is Lys, Leu or Phe; Xaa at position 128 is Gly, Leu or Phe; Xaa at position 129 is Gly, Leu or Phe; Xaa at position 130 is Ser, Leu or Phe; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; and Xaa at position 140 is Ile, Ala, Cys, Phe, His, Leu, Met, Asn, Gln, Thr, Val or Tyr; and wherein, 1 to 14 amino acids are optionally deleted from the N-terminus of the polypeptide.
10. The recombinant nucleic acid molecule of embodiment 6, wherein the AfIP-1A polypeptide comprises an amino acid sequence of SEQ ID NO: 256, wherein Xaa at position 6 is Ile or Thr; Xaa at position 7 is Ala, Met or Val; Xaa at position 8 is Thr or Asp; Xaa at position 9 is Glu, Leu or Gly; Xaa at position 10 is Glu or Asn; Xaa at position 11 is Ser or Val; Xaa at position 12 is Lys or Glu; Xaa at position 13 is Ile or Val; Xaa at position 14 is Arg or Gln; Xaa at position 16 is Tyr or Gln; Xaa at position 17 is Ala or Ser; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu or Ala; Xaa at position 24 is Ile or Leu; Xaa at position 26 is Val or Ser; Xaa at position 27 is Val or Glu; Xaa at position 29 is Ser or Met; Xaa at position 30 is Asn, Asp or Ser; Xaa at position 31 is Phe or Ile; Xaa at position 32 is Lys or Glu; Xaa at position 33 is Val or Ile; Xaa at position 34 is Glu or Lys; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Ser, Leu or Phe; Xaa at position 51 is Lys, Asn, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Leu or Phe; Xaa at position 56 is Ser, Asp or Leu; Xaa at position 57 is Gln, Thr, Glu, Leu or Phe; Xaa at position 58 is Ile, Val, Leu or Phe; Xaa at position 60 is Gly, Lys, Leu or Phe; Xaa at position 61 is Thr, Ile or Phe; Xaa at position 62 is Ile, Lys, Val, Leu or Phe; Xaa at position 64 is Lys, Ser, Glu, Leu or Phe; Xaa at position 65 is Asp, Ser, Leu or Phe; Xaa at position 66 is Glu or Gly; Xaa at position 67 is Asp, Thr or Glu; Xaa at position 68 is Ser, Lys or Thr; Xaa at position 69 is Tyr or Ser; Xaa at position 70 is Thr or Lys; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu or Ala; Xaa at position 78 is Asn or Asp; Xaa at position 79 is Ala or Thr; Xaa at position 82 is Gly, Glu, Asn, Trp or Tyr; Xaa at position 86 is Gly or Lys; Xaa at position 88 is Ser or Glu; Xaa at position 89 is Leu or Ile; Xaa at position 91 is Asp or His; Xaa at position 92 is Gly or Asp; Xaa at position 95 is Leu or Trp; Xaa at position 96 is Val, Leu or Ile; Xaa at position 97 is Phe or Ala; Xaa at position 98 is Glu or Thr; Xaa at position 100 is Tyr or Lys; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser or Ala; Xaa at position 111 is Asp, His or Asn; Xaa at position 112 is Glu or Ser; Xaa at position 113 is Leu or Ser; Xaa at position 114 is Thr or Ser; Xaa at position 115 is Val or Ile; Xaa at position 116 is Lys, Thr or Glu; Xaa at position 117 is Asp or Glu; Xaa at position 118 is Lys or Asp; Xaa at position 119 is Glu or Asn; Xaa at position 120 is Asn or Lys; Xaa at position 121 is Tyr, Leu or Phe; Xaa at position 122 is Thr, Lys, Leu or Phe; Xaa at position 123 is Val, Ile, Leu, Phe or Asn; Xaa at position 124 is Ile, Ser, Asp, Leu or Phe; Xaa at position 125 is Lys, Leu, Phe or Met; Xaa at position 126 is Lys, Glu, Leu or Phe; Xaa at position 128 is Gly, Leu or Phe; Xaa at position 129 is Gly, Asn, Leu or Phe; Xaa at position 130 is Ser, Ile, Leu or Phe; Xaa at position 131 is Pro or Ser; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val or Cys; Xaa at position 143 is Val or Ile; Xaa at position 145 is Lys or Val; and Xaa at position 146 is Ser or Gly; and wherein, 1 to 14 amino acids are optionally deleted from the N-terminus of the polypeptide.

11. The recombinant nucleic acid molecule of embodiment 6, wherein the AfIP-1A polypeptide comprises an amino acid sequence of SEQ ID NO: 257, wherein Xaa at position 6 is Ile, Thr, Leu, Met, Val or Ser; Xaa at position 7 is Ala, Met, Val, Leu, Ile or Gly; Xaa at position 8 is Thr, Asp, Ser or Glu; Xaa at position 9 is Glu, Leu, Gly, Asp, Ala, Ile, Val or Met; Xaa at position 10 is Glu, Asn, Asp or Gln; Xaa at position 11 is Ser, Val, Thr, Ile, Leu or Met; Xaa at position 12 is Lys, Glu, Arg or Asp; Xaa at position 13 is Ile, Val, Leu or Met; Xaa at position 14 is Arg, Gln, Lys or Asn; Xaa at position 16 is Tyr, Gln, Trp, Phe or Asn; Xaa at position 17 is Ala, Ser, Gly or Thr; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu, Ala, Ser, Asp or Gly; Xaa at position 24 is Ile, Leu, Val or Met; Xaa at position 26 is Val, Ser, Ile, Leu, Met or Thr; Xaa at position 27 is Val, Glu, Ile, Leu, Met or Asp; Xaa at position 29 is Ser, Met, Thr, Ile, Leu or Val; Xaa at position 30 is Asn, Asp, Ser, Glu, Gln or Thr; Xaa at position 31 is Phe, Ile, Leu, Val or Met; Xaa at position 32 is Lys, Glu, Arg or Asp; Xaa at position 33 is Val, Ile, Leu or Met; Xaa at position 34 is Glu, Lys, Asp or Arg; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Glu, Gln, Leu or Phe; Xaa at position 50 is Asp, Ser, Glu, Thr, Leu or Phe; Xaa at position 51 is Lys, Asn, Arg, Gln, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Thr, Leu or Phe; Xaa at position 56 is Ser, Asp, Thr, Glu or Leu; Xaa at position 57 is Gln, Thr, Glu, Asn, Ser, Asp, Leu or Phe; Xaa at position 58 is Ile, Val, Leu, Met or Phe; Xaa at position 60 is Gly, Lys, Ala or Arg; Xaa at position 61 is Thr, Ile or Phe; Xaa at position 62 is Ile, Lys, Val, Leu, Met, Arg or Phe; Xaa at position 64 is Lys, Ser, Glu, Arg, Thr, Asp, Leu or Phe; Xaa at position 65 is Asp, Ser, Glu, Thr, Leu or Phe; Xaa at position 66 is Glu, Gly, Asp or Ala; Xaa at position 67 is Asp, Thr, Glu or Ser; Xaa at position 68 is Ser, Lys, Thr or Arg; Xaa at position 69 is Tyr, Ser, Trp, Phe or Thr; Xaa at position 70 is Thr, Lys, Ser or Arg; Xaa at position 73 is Ser, Ala, Thr or Gly; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu, Ala, Asp or Gly; Xaa at position 78 is Asn, Asp, Gln or Glu; Xaa at position 79 is Ala, Thr, Gly or Ser; Xaa at position 82 is Gly, Glu, Asn, Trp or Tyr; Xaa at position 86 is Gly, Lys, Ala or Arg; Xaa at position 88 is Ser, Glu, Thr or Asp; Xaa at position 89 is Leu, Ile, Val or Met; Xaa at position 91 is Asp, His or Glu; Xaa at position 92 is Gly, Asp, Ala or Glu; Xaa at position 95 is Leu, Trp, Ile, Val, Met, Phe or Tyr; Xaa at position 96 is Val, Leu, Ile or Met; Xaa at position 97 is Phe, Ala or Gly; Xaa at position 98 is Glu, Thr, Asp or Ser; Xaa at position 100 is Tyr, Lys, Trp or Arg; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser, Ala, Thr or Gly; Xaa at position 111 is Asp, His, Asn, Glu or Gln; Xaa at position 112 is Glu, Ser, Asp or Thr; Xaa at position 113 is Leu, Ser, Ile, Val, Met or Thr; Xaa at position 114 is Thr or Ser; Xaa at position 115 is Val, Ile, Val or Met; Xaa at position 116 is Lys, Thr, Glu, Arg, Ser or Asp; Xaa at position 117 is Asp or Glu; Xaa at position 118 is Lys, Asp, Arg or Glu; Xaa at position 119 is Glu, Asn, Asp or Gln; Xaa at position 120 is Asn, Lys, Asp or Arg; Xaa at position 121 is Tyr, Leu or Phe; Xaa at position 122 is Thr, Lys, Ser, Arg, Leu or Phe; Xaa at position 123 is Val, Ile, Leu, Met, Phe or Asn; Xaa at position 124 is Ile, Ser, Asp, Leu, Val Met, Thr, Glu or Phe; Xaa at position 125 is Lys, Leu, Phe or Met; Xaa at position 126 is Lys, Glu, Arg, Asp, Leu or Phe; Xaa at position 128 is Gly, Leu or Phe; Xaa at position 129 is Gly, Asn, Ala, Gln, Leu or Phe; Xaa at position 130 is Ser, Ile, Thr, Leu, Val, Met or Phe; Xaa at position 131 is Pro, Ser or Thr; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val, Cys, Ile, Leu or Met; Xaa at position 143 is Val, Ile; Leu or Met; Xaa at position 145 is Lys, Val, Arg, Ile, Leu or Met; and Xaa at position 146 is Ser, Gly, Thr or Ala; and wherein, 1 to 14 amino acids are optionally deleted from the N-terminus of the polypeptide.

12. A recombinant nucleic acid molecule encoding an AfIP-1A polypeptide, wherein the recombinant nucleic acid molecule comprises a polynucleotide of SEQ ID NO: 1 or SEQ ID NO: 93, a fragment thereof or a complement thereof.
13. A recombinant nucleic acid molecule encoding an AfIP-1A polypeptide, wherein the AfIP-1A polypeptide comprises an amino acid sequence of SEQ ID NO: 2 or SEQ ID NO: 94 or a fragment thereof.
14. A recombinant nucleic acid molecule encoding an AfIP-1A polypeptide, wherein the recombinant nucleic acid molecule hybridizes under stringent conditions to a polynucleotide of SEQ ID NO: 1.
15. A recombinant nucleic acid molecule encoding an AfIP-1A polypeptide, wherein the recombinant nucleic acid molecule comprises a polynucleotide of SEQ ID NO: 1 or SEQ ID NO: 93.
16. A transgenic plant or progeny thereof, comprising the recombinant nucleic acid molecule of embodiment 1, 2, 3, 4, 5, 6, 7, 8, 9, 10, 11, 12, 13, 14 or 15.
17. A transgenic plant or progeny thereof stably transformed with the recombinant nucleic acid molecule of embodiment 1, 2, 3, 4, 5, 6, 7, 8, 9, 10, 11, 12, 13, 14 or 15.
18. The transgenic plant of embodiment 16 or 17, wherein the transgenic plant is a monocotyledon.
19. The transgenic plant of embodiment 16 or 17, wherein the transgenic plant is a dicotyledon.
20. The transgenic plant of embodiment 16 or 17, further comprising one or more additional transgenic traits.
21. The transgenic plant of embodiment 20, wherein the one or more additional transgenic trait is selected from insect resistance, herbicide resistance, fungal resistance, virus resistance or stress tolerance, disease resistance, male sterility, stalk strength, increased yield, modified starches, improved oil profile, balanced amino acids, high lysine or methionine, increased digestibility, improved fiber quality, and drought tolerance.
22. An expression cassette, comprising the recombinant nucleic acid molecule of embodiment 1, 2, 3, 4, 5, 6, 7, 8, 9, 10, 11, 12, 13, 14 or 15; and one or more regulatory sequences operably linked to and directing expression of the AfIP-1A polypeptide.
23. A transgenic plant, comprising the expression cassette of embodiment 22.
24. A transgenic plant cell, comprising the expression cassette of embodiment 22.
25. Seed, grain or processed product thereof of the transgenic plant of embodiment 23 or a progeny thereof, wherein the seed, grain or processed product thereof comprises the recombinant nucleic acid molecule.

26. The seed of embodiment 25, wherein one or more seed treatment has been applied to the seed.
27. The seed of embodiment 26, wherein the one or more seed treatment is selected from a herbicide, an insecticide, a fungicide, a germination inhibitor, a germination enhancer, a plant growth regulator, a bactericide, and a nematocide.
28. A method for expressing in a plant a nucleic acid molecule encoding an AfIP-1A polypeptide, comprising the steps of
    (a) inserting into the plant cell a nucleic acid molecule encoding an AfIP-1A polypeptide as set forth in embodiment 1, 2, 3, 4, 5, 6, 7, 8, 9, 10, 11, 12, 13, 14 or 15;
    (b) obtaining a transformed plant cell comprising the nucleic acid sequence of step (a); and
    (c) generating from the transformed plant cell a plant capable of expressing the nucleic acid molecule encoding an AfIP-1A polypeptide.
29. A transgenic plant produced by the method of embodiment 28.
30. Seed, grain or processed product thereof of the transgenic plant of embodiment 29.
31. A transgenic plant of embodiment 29, wherein the transgenic plant further comprises one or more additional transgenic traits.
32. The transgenic plant of embodiment 31, wherein the one or more additional transgenic trait is selected from insect resistance, herbicide resistance, fungal resistance, viral resistance, stress tolerance, disease resistance, male sterility, stalk strength, increased yield, modified starches, improved oil profile, balanced amino acids, high lysine or methionine, increased digestibility, improved fiber quality, flowering, ear and seed development, enhancement of nitrogen utilization efficiency, altered nitrogen responsiveness, drought resistance or tolerance, cold resistance or tolerance, salt resistance or tolerance, and increased yield under stress.
33. The transgenic plant of embodiment 31 or 32, wherein the transgenic plant is a monocotyledon.
34. The transgenic plant of embodiment 31 or 32, wherein the transgenic plant is a dicotyledon.
35. A recombinant AfIP-1A polypeptide.
36. The recombinant AfIP-1A polypeptide of embodiment 35, wherein the AfIP-1A polypeptide is from an *Alcaligenes faecalis* strain.
37. The recombinant AfIP-1A polypeptide of embodiment 36, wherein the *Alcaligenes faecalis* strain is DDMC P4G7 deposited under accession #NRRL B-50625.
38. A recombinant AfIP-1A polypeptide, comprising an amino acid motif as represented by positions 100-107 of SEQ ID NO: 257.
39. The recombinant AfIP-1A polypeptide of embodiment 38, further comprising any one or more amino acid motifs as represented by positions 15-26 of SEQ ID NO: 257, positions 33-53 of SEQ ID NO: 257, and positions 71-84 of SEQ ID NO: 257.
40. A recombinant AfIP-1A polypeptide, comprising at least 80% identity to the amino acid sequence of SEQ ID NO: 2.
41. A recombinant AfIP-1A polypeptide, comprising at least 80% identity to the amino acid sequence of SEQ ID NO: 2 and an amino acid motif as represented by positions 100-107 of SEQ ID NO: 257.
42. The recombinant AfIP-1A polypeptide of embodiment 41, wherein the AfIP-1A polypeptide further comprises any one or more amino acid motifs as represented by positions 15-26 of SEQ ID NO: 257, positions 33-53 of SEQ ID NO: 257, and positions 71-84 of SEQ ID NO: 257.
43. The recombinant AfIP-1A polypeptide of embodiment 40, wherein the AfIP-1A polypeptide comprises an amino acid sequence of SEQ ID NO: 255, wherein Xaa at position 6 is Ile or Thr; Xaa at position 7 is Ala or Val; Xaa at position 9 is Glu or Gly; Xaa at position 13 is Ile or Val; Xaa at position 19 is Trp, Glu, Phe, Ile, His, Asn or Tyr Xaa at position 20 is Ile, Val, Ala, Cys, Glu, Phe, Gly, Met, Asn, Gln, Arg, Ser or Thr; Xaa at position 23 is Thr or Ala; Xaa at position 24 is Ile or Leu; Xaa at position 30 is Asn or Ser; Xaa at position 33 is Val or Ile; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Leu or Phe; Xaa at position 51 is Lys, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Leu or Phe; Xaa at position 56 is Ser or Leu; Xaa at position 57 is Gln, Glu, Leu or Phe; Xaa at position 58 is Ile, Val, Leu or Phe; Xaa at position 60 is Gly, Leu of Phe; Xaa at position 61 is Thr, Ile or Phe; Xaa at position 62 is Ile, Val, Leu or Phe; Xaa at position 64 is Lys, Glu, Leu or Phe; Xaa at position 65 is Asp, Leu or Phe; Xaa at position 67 is Asp or Glu; Xaa at position 68 is Ser or Thr; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 82 is Gly, Glu, Asn, Trp or Tyr; Xaa at position 96 is Val or Ile; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 111 is Asp or Asn; Xaa at position 113 is Leu or Ser; Xaa at position 115 is Val or Ile; Xaa at position 116 is Lys or Glu; Xaa at position 120 is Asn or Lys; Xaa at position 121 is Tyr, Leu or Phe; Xaa at position 122 is Thr, Leu or Phe; Xaa at position 123 is Val, Leu, Phe or Asn; Xaa at position 124 is Ile, Ser, Leu or Phe; Xaa at position 125 is Lys, Leu, Phe or Met; Xaa at position 126 is Lys, Leu or Phe; Xaa at position 128 is Gly, Leu or Phe; Xaa at position 129 is Gly, Leu or Phe; Xaa at position 130 is Ser, Leu or Phe; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; and Xaa at position 140 is Ile, Ala, Cys, Phe, His, Leu, Met, Asn, Gln, Thr, Val or Tyr; and wherein, 1 to 14 amino acids are optionally deleted from the N-terminus of the polypeptide.

44. The recombinant AfIP-1A polypeptide of embodiment 40, wherein the AfIP-1A polypeptide comprises an amino acid sequence of SEQ ID NO: 256, wherein Xaa at position 6 is Ile or Thr; Xaa at position 7 is Ala, Met or Val; Xaa at position 8 is Thr or Asp; Xaa at position 9 is Glu, Leu or Gly; Xaa at position 10 is Glu or Asn; Xaa at position 11 is Ser or Val; Xaa at position 12 is Lys or Glu; Xaa at position 13 is Ile or Val; Xaa at position 14 is Arg or Gln; Xaa at position 16 is Tyr or Gln; Xaa at position 17 is Ala or Ser; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu or Ala; Xaa at position 24 is Ile or Leu; Xaa at position 26 is Val or Ser; Xaa at position 27 is Val or Glu; Xaa at position 29 is Ser or Met; Xaa at position 30 is Asn, Asp or Ser; Xaa at position 31 is Phe or Ile; Xaa at position 32 is Lys or Glu; Xaa at position 33 is Val or Ile; Xaa at position 34 is Glu or Lys; Xaa at position 35 is Gly, Lys or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Ser, Leu or Phe; Xaa at position 51 is Lys, Asn, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Leu or Phe; Xaa at position 56 is Ser, Asp or Leu; Xaa at position 57 is Gln, Thr, Glu Leu or Phe; Xaa at position 58 is Ile, Val, Leu or Phe; Xaa at position 60 is Gly, Lys, Leu or Phe; Xaa at position 61 is Thr, Ile or Phe; Xaa at position 62 is Ile, Lys, Val, Leu or Phe; Xaa at position 64 is Lys, Ser, Glu, Leu or Phe; Xaa at position 65 is Asp, Ser, Leu or Phe; Xaa at position 66 is Glu or Gly; Xaa at position 67 is Asp, Thr or Glu; Xaa at position 68 is Ser, Lys or Thr; Xaa at position 69 is Tyr or Ser; Xaa at position 70 is Thr or Lys; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu or Ala; Xaa at position 78 is Asn or Asp; Xaa at position 79 is Ala or Thr; Xaa at position 82 is Gly, Glu, Asn, Trp or Tyr; Xaa at position 86 is Gly or Lys; Xaa at position 88 is Ser or Glu; Xaa at position 89 is Leu or Ile; Xaa at position 91 is Asp or His; Xaa at position 92 is Gly or Asp; Xaa at position 95 is Leu or Trp; Xaa at position 96 is Val, Leu or Ile; Xaa at position 97 is Phe or Ala; Xaa at position 98 is Glu or Thr; Xaa at position 100 is Tyr or Lys; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser or Ala; Xaa at position 111 is Asp, His or Asn; Xaa at position 112 is Glu or Ser; Xaa at position 113 is Leu or Ser; Xaa at position 114 is Thr or Ser; Xaa at position 115 is Val or Ile; Xaa at position 116 is Lys, Thr or Glu; Xaa at position 117 is Asp or Glu; Xaa at position 118 is Lys or Asp; Xaa at position 119 is Glu or Asn; Xaa at position 120 is Asn or Lys; Xaa at position 121 is Tyr, Leu or Phe; Xaa at position 122 is Thr, Lys, Leu or Phe; Xaa at position 123 is Val, Ile, Leu, Phe or Asn; Xaa at position 124 is Ile, Ser, Asp, Leu or Phe; Xaa at position 125 is Lys, Leu, Phe or Met; Xaa at position 126 is Lys, Glu, Leu or Phe; Xaa at position 128 is Gly, Leu or Phe; Xaa at position 129 is Gly, Asn, Leu or Phe; Xaa at position 130 is Ser, Ile, Leu or Phe; Xaa at position 131 is Pro or Ser; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val or Cys; Xaa at position 143 is Val or Ile; Xaa at position 145 is Lys or Val; and Xaa at position 146 is Ser or Gly; and wherein, 1 to 14 amino acids are optionally deleted from the N-terminus of the polypeptide.

45. The recombinant AfIP-1A polypeptide of embodiment 40, wherein the AfIP-1A polypeptide comprises an amino acid sequence of SEQ ID NO: 257, wherein Xaa at position 6 is Ile, Thr, Leu, Met, Val or Ser; Xaa at position 7 is Ala, Met, Val, Leu, Ile or Gly; Xaa at position 8 is Thr, Asp, Ser or Glu; Xaa at position 9 is Glu, Leu, Gly, Asp, Ala, Ile, Val or Met; Xaa at position 10 is Glu, Asn, Asp or Gln; Xaa at position 11 is Ser, Val, Thr, Ile, Leu or Met; Xaa at position 12 is Lys, Glu, Arg or Asp; Xaa at position 13 is Ile, Val, Leu or Met; Xaa at position 14 is Arg, Gln, Lys or Asn; Xaa at position 16 is Tyr, Gln, Trp, Phe or Asn; Xaa at position 17 is Ala, Ser, Gly or Thr; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu, Ala, Ser, Asp or Gly; Xaa at position 24 is Ile, Leu, Val or Met; Xaa at position 26 is Val, Ser, Ile, Leu, Met or Thr; Xaa at position 27 is Val, Glu, Ile, Leu, Met or Asp; Xaa at position 29 is Ser, Met, Thr, Ile, Leu or Val; Xaa at position 30 is Asn, Asp, Ser, Glu, Gln or Thr; Xaa at position 31 is Phe, Ile, Leu, Val or Met; Xaa at position 32 is Lys, Glu, Arg or Asp; Xaa at position 33 is Val, Ile, Leu or Met; Xaa at position 34 is Glu, Lys, Asp or Arg; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Glu, Gln, Leu or Phe; Xaa at position 50 is Asp, Ser, Glu, Thr, Leu or Phe; Xaa at position 51 is Lys, Asn, Arg, Gln, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Thr, Leu or Phe; Xaa at position 56 is Ser, Asp, Thr, Glu, Leu; Xaa at position 57 is Gln, Thr, Glu, Asn, Ser, Asp, Leu or Phe; Xaa at position 58 is Ile, Val, Leu, Met or Phe; Xaa at position 60 is Gly, Lys, Ala or Arg; Xaa at position 61 is Thr, Ile or Phe; Xaa at position 62 is Ile, Lys, Val, Leu, Met, Arg or Phe; Xaa at position 64 is Lys, Ser, Glu, Arg, Thr, Asp, Leu or Phe; Xaa at position 65 is Asp, Ser, Glu, Thr, Leu or Phe; Xaa at position 66 is Glu, Gly, Asp or Ala; Xaa at position 67 is Asp, Thr, Glu or Ser; Xaa at position 68 is Ser, Lys, Thr or Arg; Xaa at position 69 is Tyr, Ser, Trp, Phe or Thr; Xaa at position 70 is Thr, Lys, Ser or Arg; Xaa at position 73 is Ser, Ala, Thr or Gly; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu, Ala, Asp or Gly; Xaa at position 78 is Asn, Asp, Gln or Glu; Xaa at position 79 is Ala, Thr, Gly or Ser; Xaa at position 82 is Gly, Glu, Asn, Trp or Tyr; Xaa at position 86 is Gly, Lys, Ala or Arg; Xaa at position 88 is Ser, Glu, Thr or Asp; Xaa at position 89 is Leu, Ile, Val or Met; Xaa at position 91 is Asp, His or Glu; Xaa at position 92 is Gly, Asp, Ala or Glu; Xaa at position 95 is Leu, Trp, Ile, Val, Met, Phe or Tyr; Xaa at position 96 is Val, Leu, Ile or Met; Xaa at position 97 is Phe, Ala or Gly; Xaa at position 98 is Glu, Thr, Asp or Ser; Xaa at position 100 is Tyr, Lys, Trp or Arg; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser, Ala, Thr or Gly; Xaa at position 111 is Asp, His, Asn, Glu or Gln; Xaa at position 112 is Glu, Ser, Asp or Thr; Xaa at position 113 is Leu, Ser, Ile, Val, Met or Thr; Xaa at position 114 is Thr or Ser; Xaa at position 115 is Val, Ile, Val or Met; Xaa at position 116 is Lys, Thr, Glu, Arg, Ser or Asp; Xaa at position 117 is Asp or Glu; Xaa at position 118 is Lys, Asp, Arg or Glu; Xaa at position 119 is Glu, Asn, Asp or Gln; Xaa at position 120 is Asn, Lys, Asp or Arg; Xaa at position 121 is Tyr, Leu or Phe; Xaa at position 122 is Thr, Lys, Ser, Arg, Leu or Phe; Xaa at position 123 is Val, Ile, Leu, Met, Phe or Asn; Xaa at position 124 is Ile, Ser, Asp, Leu, Val Met, Thr, Glu or Phe; Xaa at position 125 is Lys, Leu, Phe or Met; Xaa at position 126 is Lys, Glu, Arg, Asp, Leu or Phe; Xaa at position 128 is Gly, Leu or Phe; Xaa at position 129 is Gly, Asn, Ala, Gln, Leu or Phe; Xaa at position 130 is Ser, Ile, Thr, Leu, Val, Met or Phe; Xaa at position 131 is Pro, Ser or Thr; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val, Cys, Ile, Leu or Met; Xaa at position 143 is Val, Ile; Leu or Met; Xaa at position 145 is Lys, Val, Arg, Ile, Leu or Met; and Xaa at position 146 is Ser, Gly, Thr or Ala; and wherein, 1 to 14 amino acids are optionally deleted from the N-terminus of the polypeptide.

46. A recombinant AfIP-1A polypeptide, comprising an amino acid sequence of SEQ ID NO: 2 or SEQ ID NO: 94 or a fragment thereof.

47. A recombinant AfIP-1A polypeptide, comprising an amino acid sequence of SEQ ID NO: 2 or SEQ ID NO: 94.

48. A recombinant AfIP-1A polypeptide, wherein the AfIP-1A polypeptide is encoded by polynucleotide of SEQ ID NO: 1 or SEQ ID NO: 93.

49. A recombinant AfIP-1A polypeptide, comprising one or more property selected from:

a) an amino acid motif as represented by positions 15-26 of SEQ ID NO: 257;

b) an amino acid motif as represented by positions 33-53 of SEQ ID NO: 257;

c) an amino acid motif as represented by positions 71-84 of SEQ ID NO: 257;

d) an amino acid motif as represented by positions 100-107 of SEQ ID NO: 257;

e) fungicidal activity;

f) insecticidal activity;

g) a calculated molecular weight of between about 12 kD to about 18 kD.

50. A transgenic plant capable of expressing a recombinant polynucleotide encoding the AfIP-1A polypeptide of embodiment 35, 36, 37, 38, 39, 40, 41, 42, 43, 44, 45, 46, 47, 48 or 49.

51. The transgenic plant of embodiment 50, wherein the transgenic plant is a monocotyledon.

52. The transgenic plant of embodiment 50, wherein the transgenic plant is a dicotyledon.
53. The transgenic plant of embodiment 50, wherein the transgenic plant expresses one or more additional transgenic traits.
54. A composition, comprising a pesticidally-effective amount of the recombinant AfIP-1A polypeptide of embodiment 35, 36, 37, 38, 39, 40, 41, 42, 43, 44, 45, 46, 47, 48 or 49.
55. The composition of embodiment 54, further comprising an agriculturally suitable carrier.
56. The composition of embodiment 55, wherein the carrier is selected from a powder, a dust, pellets, granules, spray, emulsion, colloid and solution.
57. The composition of embodiment 56, further comprising one or more herbicides, insecticides or fungicides.
58. The composition of embodiment 57, wherein the one or more insecticides are pesticidal proteins.
59. The composition of embodiment 58, wherein the one or more pesticidal proteins are selected from a Cry1 protein, a Cry2 protein, a Cry3 protein, a Cry4 protein, a Cry5 protein, a Cry6 protein, a Cry7 protein, a Cry8 protein, a Cry9 protein, a Cry15 protein, Cry22 protein, a Cry23 protein, a Cry32 protein, a Cry34 protein, a Cry35 protein, a Cry36 protein, a Cry37 protein, a Cry43 protein, a Cry46 protein, a Cry51 protein, a Cry55 protein, a Cry binary toxin, a Cyt protein, a VIP toxin, a SIP protein, an insecticidal lipase, an insecticidal chitinase and a snake venom protein.
60. A method for controlling a fungus pest population, comprising contacting the fungus pest population with a fungicidally-effective amount of the recombinant AfIP-1A polypeptide of embodiment 35, 36, 37, 38, 39, 40, 41, 42, 43, 44, 45, 46, 47, 48 or 49.
61. A method for protecting a plant from a fungal pest, comprising expressing in the plant or cell thereof a polynucleotide encoding a pesticidally-effective amount of the recombinant AfIP-1A polypeptide of embodiment 35, 36, 37, 38, 39, 40, 41, 42, 43, 44, 45, 46, 47, 48 or 49.
62. A recombinant nucleic acid molecule encoding an AfIP-1B polypeptide.
63. The recombinant nucleic acid molecule of embodiment 62, wherein the nucleic acid molecule is from an *Alcaligenes faecalis* strain.
64. The recombinant nucleic acid molecule of embodiment 63, wherein the *Alcaligenes faecalis* strain is DDMC P4G7 deposited under accession #NRRL B-50625.
65. A recombinant nucleic acid molecule encoding an AfIP-1B polypeptide, wherein the AfIP-1B polypeptide comprises an amino acid motif as represented by positions 358-365 of SEQ ID NO: 259.
66. The recombinant nucleic acid molecule of embodiment 65, wherein the AfIP-1B polypeptide further comprises any one or more amino acid motifs as represented by positions 105-115 of SEQ ID NO: 259, positions 133-144 of SEQ ID NO: 259, positions 177-184 of SEQ ID NO: 259, and positions 511-520 of SEQ ID NO: 259.
67. A recombinant nucleic acid molecule encoding an AfIP-1B polypeptide, wherein the AfIP-1B polypeptide has at least 90% identity to the amino acid sequence of SEQ ID NO: 4.
68. A recombinant nucleic acid molecule encoding an AfIP-1B polypeptide, wherein the AfIP-1B polypeptide comprises at least 90% identity to the amino acid sequence of SEQ ID NO: 4 and an amino acid motif as represented by positions 358-365 of SEQ ID NO: 259.
69. The recombinant nucleic acid molecule of embodiment 68, wherein the AfIP-1B polypeptide further comprises any one or more amino acid motifs as represented by positions 105-115 of SEQ ID NO: 259, positions 133-144 of SEQ ID NO: 259, positions 177-184 of SEQ ID NO: 259, and positions 511-520 of SEQ ID NO: 259.
70. The recombinant nucleic acid molecule of embodiment 67, wherein the AfIP-1B polypeptide comprises an amino acid sequence of SEQ ID NO: 258, wherein Xaa at position 12 is Met or Leu; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly or Cys; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val, Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Gln, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val or Ala; Xaa at position 134 is Ser or Leu; Xaa at position 137 is Val, Phe, Ala, Leu, Trp, Pro, Ser, Cys Asp, Glu or Arg; Xaa at position 139 is Glu or Asp; Xaa at position 141 is Phe, Val, Leu, Ile, Trp, Ser or Cys; Xaa at position 144 is Ala or Val; Xaa at position 148 is Ser, Phe or Thr; Xaa at position 152 is Ile or Thr; Xaa at position 155 is Asp or Glu; Xaa at position 179 is Gly, Val, Trp, Ser, Cys or Arg; Xaa at position 181 is Ile, Val or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys or Phe; Xaa at position 202 is Lys or Asn; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile or Val; Xaa at position 296 is Lys or Glu; Xaa at position 298 is Ala or Glu; Xaa at position 299 is Glu or Gly; Xaa at position 300 is Ile or Val; Xaa at position 305 is Asp or Glu; Xaa at position 317 is Ala or Ser; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile or Val; Xaa at position 373 is Arg or Ser; Xaa at position 374 is Asn or Lys; Xaa at position 377 is Leu or Ile; Xaa at position 384 is Thr or Ala; Xaa at position 385 is Ile or Ser; Xaa at position 388 is Asp or Glu; Xaa at position 393 is Tyr or Phe; Xaa at position 398 is Ala or Val; Xaa at position 414 is Tyr or Phe; Xaa at position 418 is Ile or Leu; Xaa at position 419 is Ser or Asn; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr or Phe; Xaa at position 543 is Tyr or Phe; Xaa at position 544 is Lys or Arg; Xaa at position 547 is Tyr or Phe; Xaa at position 550 is Tyr or Phe; Xaa at position 552 is Asn or Ser; Xaa at position 558 is Phe or Leu; Xaa at position 600 is Met or Val; Xaa at position 602 is Met or Ile; Xaa at position 607 is Asp or Gly; Xaa at position 610 is Thr or Lys; Xaa at position 612 is Ile or Thr; Xaa at position 613 is Leu or Pro; Xaa at position 615 is Asn or Asp; Xaa at position 619 is Lys or Arg; Xaa at position 625 is Tyr or Phe; Xaa at position 631 is Ile, Val or Leu; Xaa at position 633 is Trp or Phe; Xaa at position 646 is Gln or Arg; Xaa at position 661 is Asn or Ser; Xaa at position 683 is Thr or Ala; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

71. The recombinant nucleic acid molecule of embodiment 67, wherein the AfIP-1B polypeptide comprises an amino acid sequence of SEQ ID NO: 4 wherein the native amino acid at 1 to 35 positions of SEQ ID NO: 4 are substituted with the native amino acid of SEQ ID NO: 20 at the corresponding position of SEQ ID NO: 4.

72. The recombinant nucleic acid molecule of embodiment 67, wherein the AfIP-1B polypeptide comprises an amino acid sequence of SEQ ID NO: 259, wherein Xaa at position 12 is Met, Leu, Ile or Val; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly, Cys or Ala; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Glu, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val, Ala, Ile or Leu; Xaa at position 134 is Ser or Leu; Xaa at position 137 is Val, Phe, Ala, Leu, Trp, Pro, Ser, Cys, Asp, Glu or Arg; Xaa at position 139 is Glu or Asp; Xaa at position 141 is Phe, Val, Leu, Ile, Trp, Ser or Cys; Xaa at position 144 is Ala, Val, Gly, Ile, Leu or Met; Xaa at position 148 is Ser, Phe, Thr or Trp; Xaa at position 152 is Ile, Thr, Leu, Val, Met or Ser; Xaa at position 155 is Asp or Glu; Xaa at position 179 is Gly, Val, Trp, Ser, Cys or Arg; Xaa at position 181 is Ile, Val, Met or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys, Tyr or Phe; Xaa at position 202 is Lys, Asn or Arg; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile, Val, Leu or Met; Xaa at position 296 is Lys or Glu; Xaa at position 298 is Ala, Glu, Gly or Asp; Xaa at position 299 is Glu, Gly, Asp or Ala; Xaa at position 300 is Ile, Val, Ile or Met; Xaa at position 305 is Asp or Glu; Xaa at position 317 is Ala, Ser, Gly or Thr; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile, Val, Leu or Met; Xaa at position 373 is Arg or Ser; Xaa at position 374 is Asn, Lys, Gln or Arg; Xaa at position 377 is Leu, Ile, Val or Met; Xaa at position 384 is Thr, Ala, Ser or Gly; Xaa at position 385 is Ile, Ser, Leu, Val, Met or Thr; Xaa at position 388 is Asp or Glu; Xaa at position 393 is Tyr, Phe or Trp; Xaa at position 398 is Ala or Val; Xaa at position 414 is Tyr or Phe; Xaa at position 418 is Ile or Leu; Xaa at position 419 is Ser, Asn, Thr or Gln; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr, Phe or Trp; Xaa at position 543 is Tyr or Phe; Xaa at position 544 is Lys or Arg; Xaa at position 547 is Tyr or Phe; Xaa at position 550 is Tyr, Phe or Trp; Xaa at position 552 is Asn, Ser, Gln or Thr; Xaa at position 558 is Phe or Leu; Xaa at position 600 is Met or Val; Xaa at position 602 is Met, Ile, Leu or Val; Xaa at position 607 is Asp or Gly; Xaa at position 610 is Thr, Lys, Ser or Arg; Xaa at position 612 is Ile or Thr; Xaa at position 613 is Leu or Pro; Xaa at position 615 is Asn or Asp; Xaa at position 619 is Lys or Arg; Xaa at position 625 is Tyr, Phe or Trp; Xaa at position 631 is Ile, Val, Leu or Met; Xaa at position 633 is Trp or Phe; Xaa at position 646 is Gln or Arg; Xaa at position 661 is Asn or Ser; Xaa at position 683 is Thr, Ala, Ser or Gly; and Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

73. The recombinant nucleic acid molecule of embodiment 70, wherein the AfIP-1B polypeptide further comprises one or more amino acid substitution of the native amino acid of SEQ ID NO: 20 at the corresponding position of SEQ ID NO: 4.

74. The recombinant nucleic acid molecule of embodiment 72, wherein the AfIP-1B polypeptide further comprises one or more amino acid substitutions of the native amino acid of SEQ ID NO: 20 at the corresponding position of SEQ ID NO: 4.
75. A recombinant nucleic acid molecule encoding an AfIP-1B polypeptide, comprising a polynucleotide of SEQ ID NO: 3 or SEQ ID NO: 75, a fragment thereof or a complement thereof.
76. A recombinant nucleic acid molecule encoding an AfIP-1B polypeptide, wherein the AfIP-1B polypeptide comprises an amino acid sequence of SEQ ID NO: 4 or SEQ ID NO: 76 or a fragment thereof.
77. A recombinant nucleic acid molecule encoding an AfIP-1B polypeptide, wherein the recombinant nucleic acid molecule hybridizes under stringent conditions to a polynucleotide of SEQ ID NO: 3.
78. A recombinant nucleic acid molecule encoding an AfIP-1B polypeptide, wherein the recombinant nucleic acid molecule comprises a polynucleotide of SEQ ID NO: 3 or SEQ ID NO: 75.
79. A transgenic plant or progeny thereof, comprising the recombinant nucleic acid molecule of embodiment 62, 63, 64, 65, 66, 67, 68, 69, 70, 71, 72, 73, 74, 75, 76, 77 or 78.
80. A transgenic plant or progeny thereof stably transformed with the recombinant nucleic acid molecule of embodiment 62, 63, 64, 65, 66, 67, 68, 69, 70, 71, 72, 73, 74, 75, 76, 77 or 78.
81. The transgenic plant of embodiment 79 or 80, wherein the transgenic plant is a monocotyledon.
82. The transgenic plant of embodiment 79 or 80, wherein the transgenic plant is a dicotyledon.
83. The transgenic plant of embodiment 79 or 80, further comprising one or more additional transgenic traits.
84. The transgenic plant of embodiment 83, wherein the one or more additional transgenic trait is selected from insect resistance, herbicide resistance, fungal resistance, virus resistance or stress tolerance, disease resistance, male sterility, stalk strength, increased yield, modified starches, improved oil profile, balanced amino acids, high lysine or methionine, increased digestibility, improved fiber quality, and drought tolerance.
85. An expression cassette, comprising the recombinant nucleic acid molecule of embodiment 62, 63, 64, 65, 66, 67, 68, 69, 70, 71, 72, 73, 74, 75, 76, 77 or 78, wherein the nucleic acid is operably linked to one or more regulatory sequences directing expression of the AfIP-1B polypeptide.
86. A transgenic plant, comprising the expression cassette of embodiment 85.
87. A plant cell, comprising the expression cassette of embodiment 85.
88. Seed, grain or processed product thereof of the transgenic plant of embodiment 86 or a progeny thereof, wherein the seed, grain or processed product thereof comprises the recombinant nucleic acid molecule.
89. The seed of embodiment 88, wherein one or more seed treatment has been applied to the seed.
90. The seed of embodiment 89, wherein the one or more seed treatment is selected from a herbicide, an insecticide, a fungicide, a germination inhibitor, a germination enhancer, a plant growth regulator, a bactericide, and a nematocide.
91. A method for expressing in a plant a polynucleotide encoding an AfIP-1B polypeptide, comprising the steps of
    (a) inserting into the plant cell a nucleic acid molecule encoding an AfIP-1B polypeptide as set forth in embodiment 62, 63, 64, 65, 66, 67, 68, 69, 70, 71, 72, 73, 74, 75, 76; 77 or 78;
    (b) obtaining a transformed plant cell comprising the nucleic acid sequence of step (a); and
    (c) generating from the transformed plant cell a plant capable of expressing the nucleic acid molecule encoding the AfIP-1B polypeptide.
92. A transgenic plant produced by the method of embodiment 91.
93. Seed, grain or processed products thereof of the transgenic plant of embodiment 92.
94. A transgenic plant of embodiment 92, wherein the transgenic plant further comprises one or more additional transgenic traits.
95. The transgenic plant of embodiment 94, wherein the one or more additional transgenic trait is selected from insect resistance, herbicide resistance, fungal resistance, viral resistance, stress tolerance, disease resistance, male sterility, stalk strength, increased yield, modified starches, improved oil profile, balanced amino acids, high lysine or methionine, increased digestibility, improved fiber quality, flowering, ear and seed development, enhancement of nitrogen utilization efficiency, altered nitrogen responsiveness, drought resistance or tolerance, cold resistance or tolerance, salt resistance or tolerance, and increased yield under stress.
96. The transgenic plant of embodiment 94 or 95, wherein the transgenic plant is a monocotyledon.
97. The transgenic plant of embodiment 94 or 95, wherein the transgenic plant is a dicotyledon.
98. A recombinant AfIP-1B polypeptide.
99. The recombinant AfIP-1B polypeptide of embodiment 98, wherein the AfIP-1B polypeptide is from an *Alcaligenes faecalis* strain.
100. The recombinant AfIP-1B polypeptide of embodiment 99, wherein the *Alcaligenes faecalis* strain is DDMC P4G7 deposited under accession #NRRL B-50625.
101. A recombinant AfIP-1B polypeptide, comprising an amino acid motif as represented by positions 358-365 of SEQ ID NO: 259.
102. The recombinant AfIP-1B polypeptide of embodiment 101, further comprising any one or more amino acid motifs as represented by positions 105-115 of SEQ ID NO: 259, positions 133-144 of SEQ ID NO: 259, positions 177-184 of SEQ ID NO: 259, and positions 511-520 of SEQ ID NO: 259.
103. A recombinant AfIP-1B polypeptide, comprising at least 90% identity to the amino acid sequence of SEQ ID NO: 4.
104. A recombinant AfIP-1B polypeptide, comprising at least 90% identity to the amino acid sequence of SEQ ID NO: 4 and an amino acid motif as represented by positions 358-365 of SEQ ID NO: 259.
105. The recombinant AfIP-1B polypeptide of embodiment 104, wherein the AfIP-1B polypeptide further comprises any one or more amino acid motifs as represented by positions 105-115 of SEQ ID NO: 259, positions 133-144 of SEQ ID NO: 259, positions 177-184 of SEQ ID NO: 259, and positions 511-520 of SEQ ID NO: 259.
106. The recombinant AfIP-1B polypeptide of embodiment 103, wherein the AfIP-1B polypeptide comprises an amino acid sequence of SEQ ID NO: 258, wherein Xaa at position 12 is Met or Leu; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly or Cys; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val Leu, Trp, Phe, Pro, Thr, Cys, Asn, Gln or Arg; Xaa at position 106 is Ile or Leu; Xaa at position 108 is Gly, Ala, Leu, Ile, Met, Trp, Phe, Ser, Thr, Cys, Tyr, Asn, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val or Ala; Xaa at position 134 is Ser or Leu; Xaa at position 137 is Val, Phe, Ala, Leu, Trp, Pro, Ser or Cys; Xaa at position 139 is Glu or Asp; Xaa at position 141 is Phe, Leu, Ile, Trp, Ser or Cys; Xaa at position 144 is Ala or Val; Xaa at position 148 is Ser, Phe or Thr; Xaa at position 152 is Ile or Thr; Xaa at position 155 is Asp or Glu; Xaa at position 179 is Gly, Val, Trp, Ser, Cys or Arg; Xaa at position 181 is Ile, Val or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys or Phe; Xaa at position 202 is Lys or Asn; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile or Val; Xaa at position 296 is Lys or Glu; Xaa at position 298 is Ala or Glu; Xaa at position 299 is Glu or Gly; Xaa at position 300 is Ile or Val; Xaa at position 305 is Asp or Glu; Xaa at position 317 is Ala or Ser; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Ser, Thr, Lys or Arg; Xaa at position 360 is Asn, Gly, Val, Leu, Met, Phe, Pro, Thr, Asn, Asp, Lys or His; Xaa at position 361 is Ser, Gly, Val, Leu or Glu; Xaa at position 363 is Asp, Gly, Trp or Ser; Xaa at position 364 is Val, Pro, Ser, Thr, Asn, Glu or Lys; Xaa at position 365 is Leu, Gly, Ala, Val, Ile, Trp, Phe, Pro, Ser, Thr, Gln, Glu, Arg or His; Xaa at position 367 is Glu or Lys; Xaa at position 368 is Gly or Asp; Xaa at position 370 is Ile or Val; Xaa at position 373 is Arg or Ser; Xaa at position 374 is Asn or Lys; Xaa at position 377 is Leu or Ile; Xaa at position 384 is Thr or Ala; Xaa at position 385 is Ile or Ser; Xaa at position 388 is Asp or Glu; Xaa at position 393 is Tyr or Phe; Xaa at position 398 is Ala or Val; Xaa at position 414 is Tyr or Phe; Xaa at position 418 is Ile or Leu; Xaa at position 419 is Ser or Asn; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp or Lys; Xaa at position 526 is Val or Leu; Xaa at position 530 is Ile or Leu; Xaa at position 533 is Val or Ala; Xaa at position 536 is Ile or Leu; Xaa at position 538 is Tyr or Phe; Xaa at position 543 is Tyr or Phe; Xaa at position 544 is Lys or Arg; Xaa at position 547 is Tyr or Phe; Xaa at position 550 is Tyr or Phe; Xaa at position 552 is Asn or Ser; Xaa at position 558 is Phe or Leu; Xaa at position 600 is Met or Val; Xaa at position 602 is Met or Ile; Xaa at position 607 is Asp or Gly; Xaa at position 610 is Thr or Lys; Xaa at position 612 is Ile or Thr; Xaa at position 613 is Leu or Pro; Xaa at position 615 is Asn or Asp; Xaa at position 619 is Lys or Arg; Xaa at position 625 is Tyr or Phe; Xaa at position 631 is Ile, Val or Leu; Xaa at position 633 is Trp or Phe; Xaa at position 646 is Gln or Arg; Xaa at position 661 is Asn or Ser; Xaa at position 683 is Thr or Ala; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

107. The recombinant AfIP-1B polypeptide of embodiment 103, wherein the AfIP-1B polypeptide comprises an amino acid sequence of SEQ ID NO: 4 wherein the native amino acid at 1 to 35 positions of SEQ ID NO: 4 are substituted with the native amino acid of SEQ ID NO: 20 at the corresponding position of SEQ ID NO: 20.

108. The recombinant AfIP-1B polypeptide of embodiment 103, wherein the AfIP-1B polypeptide comprises an amino acid sequence of SEQ ID NO: 259, wherein Xaa at position 12 is Met, Leu, Ile or Val; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly, Cys or Ala; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val Leu, Trp, Phe, Pro, Thr, Cys, Asn, Gln or Arg; Xaa at position 106 is Ile or Leu; Xaa at position 108 is Gly, Ala, Leu, Ile, Met, Trp, Phe, Ser, Thr, Cys, Tyr, Asn, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val, Ala, Ile or Leu; Xaa at position 134 is Ser or Leu; Xaa at position 137 is Val, Phe, Ala, Leu, Trp, Pro, Ser or Cys; Xaa at position 139 is Glu or Asp; Xaa at position 141 is Phe, Leu, Ile, Trp, Ser or Cys; Xaa at position 144 is Ala, Val, Gly, Ile, Leu or Met; Xaa at position 148 is Ser, Phe, Thr or Trp; Xaa at position 152 is Ile, Thr, Leu, Val, Met or Ser; Xaa at position 155 is Asp or Glu; Xaa at position 179 is Gly, Val, Trp, Ser, Cys or Arg; Xaa at position 181 is Ile, Val, Met or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys, Tyr or Phe; Xaa at position 202 is Lys, Asn or Arg; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile, Val, Leu or Met; Xaa at position 296 is Lys or Glu; Xaa at position 298 is Ala, Glu, Gly or Asp; Xaa at position 299 is Glu, Gly, Asp or Ala; Xaa at position 300 is Ile, Val, Ile or Met; Xaa at position 305 is Asp or Glu; Xaa at position 317 is Ala, Ser, Gly or Thr; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Ser, Thr, Lys or Arg; Xaa at position 360 is Asn, Gly, Val, Leu, Met, Phe, Pro, Thr, Asn, Asp, Lys or His; Xaa at position 361 is Ser, Gly, Val, Leu or Glu; Xaa at position 363 is Asp, Gly, Trp or Ser; Xaa at position 364 is Val, Pro, Ser, Thr, Asn, Glu or Lys; Xaa at position 365 is Leu, Gly, Ala, Val, Ile, Trp, Phe, Pro, Ser, Thr, Gln, Glu, Arg or His; Xaa at position 367 is Glu or Lys; Xaa at position 368 is Gly or Asp; Xaa at position 370 is Ile, Val, Leu or Met; Xaa at position 373 is Arg or Ser; Xaa at position 374 is Asn, Lys, Gln or Arg; Xaa at position 377 is Leu, Ile, Val or Met; Xaa at position 384 is Thr, Ala, Ser or Gly; Xaa at position 385 is Ile, Ser, Leu, Val, Met or Thr; Xaa at position 388 is Asp or Glu; Xaa at position 393 is Tyr, Phe or Trp; Xaa at position 398 is Ala or Val; Xaa at position 414 is Tyr or Phe; Xaa at position 418 is Ile or Leu; Xaa at position 419 is Ser, Asn, Thr or Gln; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp or Lys; Xaa at position 526 is Val or Leu; Xaa at position 530 is Ile or Leu; Xaa at position 533 is Val or Ala; Xaa at position 536 is Ile or Leu; Xaa at position 538 is Tyr, Phe or Trp; Xaa at position 543 is Tyr or Phe; Xaa at position 544 is Lys or Arg; Xaa at position 547 is Tyr or Phe; Xaa at position 550 is Tyr, Phe or Trp; Xaa at position 552 is Asn, Ser, Gln or Thr; Xaa at position 558 is Phe or Leu; Xaa at position 600 is Met or Val; Xaa at position 602 is Met, Ile, Leu or Val; Xaa at position 607 is Asp or Gly; Xaa at position 610 is Thr, Lys, Ser or Arg; Xaa at position 612 is Ile or Thr; Xaa at position 613 is Leu or Pro; Xaa at position 615 is Asn or Asp; Xaa at position 619 is Lys or Arg; Xaa at position 625 is Tyr, Phe or Trp; Xaa at position 631 is Ile, Val, Leu or Met; Xaa at position 633 is Trp or Phe; Xaa at position 646 is Gln or Arg; Xaa at position 661 is Asn or Ser; Xaa at position 683 is Thr, Ala, Ser or Gly; and Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

109. The recombinant AfIP-1B polypeptide of embodiment 106, wherein the AfIP-1B polypeptide further comprises one or more amino acid substitutions of the native amino acid of SEQ ID NO: 20 at the corresponding position of SEQ ID NO: 4.

110. The recombinant AfIP-1B polypeptide of embodiment 108, wherein the AfIP-1B polypeptide further comprises one or more amino acid substitutions of the native amino acid of SEQ ID NO: 20 at the corresponding position of SEQ ID NO: 4.

111. A recombinant AfIP-1B polypeptide, comprising an amino acid sequence of SEQ ID NO: 4 or SEQ ID NO: 76 or a fragment thereof.

112. A recombinant AfIP-1B polypeptide, comprising an amino acid sequence of SEQ ID NO: 4 or SEQ ID NO: 76.

113. A recombinant AfIP-1B polypeptide, wherein the AfIP-1B polypeptide is encoded by the polynucleotide of SEQ ID NO: 3 or SEQ ID NO: 75.

114. A recombinant AfIP-1B polypeptide, comprising one or more property selected from a) an amino acid motif as represented by positions 101-105 of SEQ ID NO: 259;

b) an amino acid motif as represented by positions 133-144 of SEQ ID NO: 259;

c) an amino acid motif as represented by positions 177-184 of SEQ ID NO: 259;

d) an amino acid motif as represented by positions 358-365 of SEQ ID NO: 259;

e) an amino acid motif as represented by positions 511-520 of SEQ ID NO: 259;

f) fungicidal activity;

g) insecticidal activity; and h) a calculated molecular weight of between about 72.5 kD and about 80 kD.

115. A transgenic plant capable of expressing a recombinant polynucleotide encoding the AfIP-1B polypeptide of embodiment 98, 99, 100, 101, 102, 103, 104, 105, 106, 107, 108, 109, 110, 111, 112, 113 or 114.

116. The transgenic plant of embodiment 115, wherein the transgenic plant is a monocotyledon.

117. The transgenic plant of embodiment 115, wherein the transgenic plant is a dicotyledon.

118. The transgenic plant of embodiment 115, wherein the transgenic plant expresses one or more additional transgenic traits.

119. A composition, comprising a pesticidally-effective amount of the recombinant AfIP-1B polypeptide of embodiment 98, 99, 100, 101, 102, 103, 104, 105, 106, 107, 108, 109, 110, 111, 112, 113 or 114.

120. The composition of embodiment 119, further comprising an agriculturally suitable carrier.

121. The composition of embodiment 120, wherein the carrier is selected from a powder, a dust, pellets, granules, spray, emulsion, colloid, and solution.

122. The composition of embodiment 119, further comprising one or more herbicides, insecticides or fungicides.

123. The composition of embodiment 122, wherein the one or more insecticides are pesticidal proteins.

124. The composition of embodiment 123, wherein the one or more pesticidal proteins are selected from a Cry1 protein, a Cry2 protein, a Cry3 protein, a Cry4 protein, a Cry5 protein, a Cry6 protein, a Cry7 protein, a Cry8 protein, a Cry9 protein, a Cry15 protein, Cry22 protein, a Cry23 protein, a Cry32 protein, a Cry34 protein, a Cry35 protein, a Cry36 protein, a Cry37 protein, a Cry43 protein, a Cry46 protein, a Cry51 protein, a Cry55 protein, a Cry binary toxin, a Cyt protein, a VIP toxin, a SIP protein, an insecticidal lipase, an insecticidal chitinase, and a snake venom protein.

125. A method for controlling a fungus pest population, comprising contacting the fungus pest population with a fungicidally-effective amount of the recombinant AfIP-1B polypeptide of embodiment 98, 99, 100, 101, 102, 103, 104, 105, 106, 107, 108, 109, 110, 111, 112, 113 or 114.

126. A method for protecting a plant from a fungus pest, comprising expressing in the plant or cell thereof a polynucleotide encoding pesticidally-effective amount of the recombinant AfIP-1B polypeptide of embodiment 98, 99, 100, 101, 102, 103, 104, 105, 106, 107, 108, 109, 110, 111, 112, 113 or 114.

127. A composition, comprising an insecticidally-effective amount of a) the recombinant AfIP-1A polypeptide of embodiment 35, 36, 37, 38, 39, 40, 41, 42, 43, 44, 45, 46, 47, 48 or 49 or the polypeptide of SEQ ID NO: 18; and b) the recombinant AfIP-1B polypeptide of embodiment 98, 99, 100, 101, 102, 103, 104, 105, 106, 107, 108, 109, 110, 111, 112, 113 or 114 or the polypeptide of SEQ ID NO: 20.

128. A method of inhibiting growth or killing an insect pest, comprising contacting the insect pest with the composition of embodiment 127.

129. A method for controlling an insect pest population resistant to a pesticidal protein, comprising contacting the resistant insect pest population with the composition of embodiment 127.

130. The method of controlling an insect pest population resistant to an pesticidal protein of embodiment 129, wherein the pesticidal protein is selected from Cry1Ac, Cry1Ab, Cry1A.105, Cry1Ac, Cry1F, Cry1Fa2, Cry1F, Cry2Ab, Cry3A, mCry3A, Cry3Bb1, Cry34Ab1, Cry35Ab1, Vip3A, Cry9c, eCry3.1Ab and CBI-Bt.

131. A biologically pure culture of *Alcaligenes faecalis* strain DDMC P4G7 deposited under accession #NRRL B-50625.

132. A method of isolating an AfIP-1A polypeptide or AfIP-1B polypeptide having pesticidal activity from a *Alcaligenes faecalis* strain, comprising a) obtaining a protein cell lysate from a bacterial isolate;

b) screening the protein cell lysate for pesticidal activity; and c) isolating a pesticidal protein from the protein cell lysate.

133. A recombinant receptor to the polypeptide of SEQ ID NO: 2, SEQ ID NO: 4, SEQ ID NO: 18 or SEQ ID NO: 20.

134. A method of identifying an AfIP-1A polypeptide or AfIP-1B polypeptide in a biological sample, comprising contacting the biological sample with the receptor of embodiment 133.

135. An isolated antibody or antigen-binding portion thereof, wherein the antibody binds specifically to the AfIP-1A polypeptide of embodiment 35, 36, 37, 38, 39, 40, 41, 42, 43, 44, 45, 46, 47, 48 or 49.

136. A method of detecting an AfIP-1A polypeptide in a biological sample comprising, contacting the protein with the antibody of embodiment 135.

137. A method of isolating an AfIP-1A polypeptide in a biological sample comprising, contacting the protein with the antibody of embodiment 135.

138. An isolated antibody or antigen-binding portion thereof, wherein the antibody binds specifically to the AfIP-1B polypeptide of embodiment 98, 99, 100, 101, 102, 103, 104, 105, 106, 107, 108, 109, 110, 111, 112, 113 or 114.

139. A method of detecting an AfIP-1B polypeptide in a biological sample comprising, contacting the protein with the antibody of embodiment 138.

140. A method of isolating an AfIP-1B polypeptide in a biological sample comprising, contacting the protein with the antibody of embodiment 138.

141. A transgenic plant or progeny thereof, comprising the recombinant nucleic acid molecule of embodiment 1, 2, 3, 4, 5, 6, 7, 8, 9, 10, 11, 12, 13, 14 or 15 or a recombinant nucleic acid molecule encoding the polypeptide of SEQ ID NO: 18; and the recombinant nucleic acid molecule of embodiment 62, 63, 64, 65, 66, 67, 68, 69, 70, 71, 72, 73, 74, 75 or 76 or a recombinant nucleic acid molecule encoding the polypeptide of SEQ ID NO: 20.

142. A transgenic plant or progeny thereof stably transformed with the recombinant nucleic acid molecule of embodiment 1, 2, 3, 4, 5, 6, 7, 8, 9, 10, 11, 12, 13, 14 or 15 or a recombinant nucleic acid molecule encoding the polypeptide of SEQ ID NO: 18; and the recombinant nucleic acid molecule of embodiment 62, 63, 64, 65, 66, 67, 68, 69, 70, 71, 72, 73, 74, 75, 76, 77 or 78 or a recombinant nucleic acid molecule encoding the polypeptide of SEQ ID NO: 20.

143. The transgenic plant or progeny thereof of embodiment 141 or 142, wherein the transgenic plant is a monocotyledon.

144. The transgenic plant or progeny thereof of embodiment 141 or 142, wherein the transgenic plant is a dicotyledon.

145. The transgenic plant or progeny thereof of embodiment 141 or 142, wherein the plant is selected from barley, corn, oat, rice, rye, sorghum, turf grass, sugarcane, wheat, alfalfa, banana, broccoli, bean, cabbage, canola, carrot, cassava, cauliflower, celery, citrus, cotton, a cucurbit, eucalyptus, flax, garlic, grape, onion, lettuce, pea, peanut, pepper, potato, poplar, pine, sunflower, safflower, soybean, strawberry, sugar beet, sweet potato, tobacco, tomato ornamental, shrub, nut, chickpea, pigeon pea, millets, hops and pasture grasses.

146. The transgenic plant or progeny thereof of embodiment 141 or 142, further comprising one or more additional transgenic traits.

147. The transgenic plant of embodiment 146, wherein the one or more additional transgenic trait is selected from insect resistance, herbicide resistance, fungal resistance, viral resistance, stress tolerance, disease resistance, male sterility, stalk strength, increased yield, modified starches, improved oil profile, balanced amino acids, high lysine or methionine, increased digestibility, improved fiber quality, flowering, ear and seed development, enhancement of nitrogen utilization efficiency, altered nitrogen responsiveness, drought resistance or tolerance, cold resistance or tolerance, salt resistance or tolerance and increased yield under stress.

148. An expression cassette, comprising the recombinant nucleic acid molecule of embodiment 1, 2, 3, 4, 5, 6, 7, 8, 9, 10, 11, 12, 13, 14 or 15 or a recombinant nucleic acid molecule of SEQ ID NO: 17, wherein the nucleic acid is operably linked to one or more regulatory sequences directing expression of an AfIP-1A polypeptide or the polypeptide of SEQ ID NO: 18; and the recombinant nucleic acid molecule of embodiment 62, 63, 64, 65, 66, 67, 68, 69, 70, 71, 72, 73, 74, 75, 76, 77 or 78 or a recombinant nucleic acid molecule of SEQ ID NO: 19, wherein the nucleic acid is operably linked to one or more regulatory sequences directing expression of an AfIP-1B polypeptide or the polypeptide of SEQ ID NO: 20.

149. A transgenic plant, comprising the expression cassette of embodiment 148.

150. A plant cell, comprising the expression cassette of embodiment 148.

151. Seed, grain or processed product thereof of the transgenic plant of embodiment 149, wherein the seed, grain or processed product thereof comprises the recombinant nucleic acid molecule of embodiment of 1, 2, 3, 4, 5, 6, 7, 8, 9, 10, 11, 12, 13, 14 or 15 or recombinant nucleic acid molecule of SEQ ID NO: 17, and the recombinant nucleic acid molecule of 62, 63, 64, 65, 66, 67, 68, 69, 70, 71, 72, 73, 74, 75, 76, 77 or 78 or recombinant nucleic acid molecule of SEQ ID NO: 19.

152. The seed of embodiment 151, wherein one or more seed treatment has been applied to the seed.

153. A method for expressing in a plant a polynucleotide encoding an insecticidal protein, comprising
(a) inserting into a plant cell the recombinant nucleic acid molecule of embodiment 1, 2, 3, 4, 5, 6, 7, 8, 9, 10, 11, 12, 13, 14 or 15 encoding an AfIP-1A polypeptide; and the recombinant nucleic acid molecule of embodiment 62, 63, 64, 65, 66, 67, 68, 69, 70, 71, 72, 73, 74, 75, 76, 77 or 78 encoding an AfIP-1B polypeptide;
(b) obtaining a transformed plant cell comprising the nucleic acid sequence of step (a); and
(c) generating from the transformed plant cell a plant capable of expressing the nucleic acid molecules encoding an AfIP-1A polypeptide and an AfIP-1B polypeptide.

154. A transgenic plant produced by the method of embodiment 153.

155. Seed, grain or processed product thereof of the transgenic plant of embodiment 154.

156. The transgenic plant of embodiment 154, wherein the transgenic plant further comprises one or more additional transgenic traits.

157. A transgenic plant capable of expressing at least one polynucleotide encoding the AfIP-1A polypeptide of embodiment 35, 36, 37, 38, 39, 40, 41, 42, 43, 44, 45, 46, 47, 48 or 49, and the AfIP-1B polypeptide of embodiment 98, 99, 100, 101, 102, 103, 104, 105, 106, 107, 108, 109, 110, 111, 112, 113 or 114.

158. A method for protecting a plant from an insect pest, comprising expressing in the plant or cell thereof an insecticidally-effective amount of
a) the AfIP-1A polypeptide of embodiment 35, 36, 37, 38, 39, 40, 41, 42, 43, 44, 45, 46, 47, 48 or 49; and
b) the AfIP-1B polypeptide of embodiment 98, 99, 100, 101, 102, 103, 104, 105, 106, 107, 108, 109, 110, 111, 112, 113 or 114.

159. A method for controlling an insect pest population, comprising contacting the insect pest population with an insecticidally-effective amount of the AfIP-1A polypeptide of embodiment 35, 36, 37, 38, 39, 40, 41, 42, 43, 44, 45, 46, 47, 48 or 49; and the AfIP-1B polypeptide of embodiment 98, 99, 100, 101, 102, 103, 104, 105, 106, 107, 108, 109, 110, 111, 112, 113 or 114.

160. A method of inhibiting growth or killing an insect pest, comprising contacting the insect pest with a composition comprising an insecticidally-effective amount of the AfIP-1A polypeptide of embodiment 35, 36, 37, 38, 39, 40, 41, 42, 43, 44, 45, 46, 47, 48 or 49; and the AfIP-1B polypeptide of embodiment 98, 99, 100, 101, 102, 103, 104, 105, 106, 107, 108, 109, 110, 111, 112, 113 or 114.

161. A method for controlling an insect pest population resistant to a pesticidal protein, comprising contacting the insect pest population with an insecticidally-effective amount of the AfIP-1A polypeptide of embodiment 35, 36, 37, 38, 39, 40, 41, 42, 43, 44, 45, 46, 47, 48 or 49; and the AfIP-1B polypeptide of embodiment 98, 99, 100, 101, 102, 103, 104, 105, 106, 107, 108, 109, 110, 111, 112, 113 or 114.

162. A method of controlling Lepidoptera and/or Coleoptera insect infestation in a transgenic plant and providing insect resistance management, comprising expressing in the plant an insecticidally-effective amount of
a) the AfIP-1A polypeptide of embodiment 35, 36, 37, 38, 39, 40, 41, 42, 43, 44, 45, 46, 47, 48 or 49; and the AfIP-1B polypeptide of embodiment 98, 99, 100, 101, 102, 103, 104, 105, 106, 107, 108, 109, 110, 111, 112, 113 or 114; and
b) at least one insecticidal protein having a different mode of action compared to the AfIP-1A polypeptide and AfIP-1B polypeptide.

163. The method of embodiment 162, wherein the insecticidal protein of b) comprises a Cry protein insecticidal to insects in the order Lepidoptera and/or Coleoptera.

164. A method of reducing likelihood of emergence of Lepidoptera and/or Coleoptera insect resistance to transgenic plants expressing in the plants insecticidal proteins to control the insect species, comprising
a) expressing a polynucleotide encoding the AfIP-1A polypeptide of embodiment 35, 36, 37, 38, 39, 40, 41, 42, 43, 44, 45, 46, 47, 48, 49 or 50; and the AfIP-1B polypeptide of embodiment 98, 99, 100, 101, 102, 103, 104, 105, 106, 107, 108, 109, 110, 111, 112, 113 or 114; and
b) expressing a polynucleotide encoding at least one insecticidal protein having a different mode of action compared to the AfIP-1A polypeptide and AfIP-1B polypeptide of a).

165. The method of embodiment 164, wherein the insecticidal protein of b) is a Cry protein.

166. A method for controlling an insect pest population, comprising contacting the insect pest population with an insecticidally-effective amount of a recombinant polypeptide comprising the amino acid sequence of SEQ ID NO: 18 and a recombinant polypeptide comprising the amino acid sequence of SEQ ID NO: 20.

167. A method of inhibiting growth or killing an insect pest, comprising contacting the insect pest with a composition comprising an insecticidally-effective amount of a recombinant polypeptide comprising the amino acid sequence of SEQ ID NO: 18 and a recombinant polypeptide comprising the amino acid sequence of SEQ ID NO: 20.

168. A method for controlling an insect pest population resistant to a pesticidal protein, comprising contacting the insect pest population with an insecticidally-effective amount of a recombinant polypeptide comprising the amino acid sequence of SEQ ID NO: 18 and a recombinant polypeptide comprising the amino acid sequence of SEQ ID NO: 20.

169. A method for protecting a plant from an insect pest, comprising expressing in the plant or cell thereof a polynucleotide encoding a recombinant polypeptide comprising the amino acid sequence of SEQ ID NO: 18 and a recombinant polypeptide comprising the amino acid sequence of SEQ ID NO: 20.

170. A transgenic plant or progeny thereof, comprising a recombinant nucleic acid molecule comprising the nucleic acid sequence of SEQ ID NO: 17 and a recombinant nucleic acid molecule comprising the nucleic acid sequence of SEQ ID NO: 19.

171. A transgenic plant or progeny thereof stably transformed with a recombinant nucleic acid molecule comprising the nucleic acid sequence of SEQ ID NO: 17 and a recombinant nucleic acid molecule comprising the nucleic acid sequence of SEQ ID NO: 19.

172. The transgenic plant or progeny thereof of embodiment 170 or 171, wherein the transgenic plant is a monocotyledon.

173. The transgenic plant or progeny thereof of embodiment 170 or 171, wherein the transgenic plant is a dicotyledon.

174. The transgenic plant or progeny thereof of embodiment 170 or 171, wherein the transgenic plant is selected from barley, corn, oat, rice, rye, sorghum, turf grass, sugarcane, wheat, alfalfa, banana, broccoli, bean, cabbage, canola, carrot, cassava, cauliflower, celery, citrus, cotton, a cucurbit, eucalyptus, flax, garlic, grape, onion, lettuce, pea, peanut, pepper, potato, poplar, pine, sunflower, safflower, soybean, strawberry, sugar beet, sweet potato, tobacco, tomato ornamental, shrub, nut, chickpea, pigeon pea, millets, hops, and pasture grasses.

175. The transgenic plant or progeny thereof of embodiment 170 or 171, further comprising one or more additional transgenic traits.

176. An expression cassette, comprising
  a) a recombinant nucleic acid molecule encoding a polypeptide comprising the amino acid sequence of SEQ ID NO: 18, wherein the nucleic acid is operably linked to one or more regulatory sequences directing expression of the polypeptide of SEQ ID NO: 18; and
  b) a recombinant nucleic acid molecule encoding a polypeptide comprising the amino acid sequence of SEQ ID NO: 20, wherein the nucleic acid is operably linked to one or more regulatory sequences directing expression of polypeptide of SEQ ID NO: 20.

177. A transgenic plant, comprising the expression cassette of embodiment 176.

178. A plant cell, comprising the expression cassette of embodiment 176.

179. Seed, grain or processed product thereof of the transgenic plant of embodiment 177, wherein the seed, grain or processed product comprises the recombinant nucleic acid molecule.

180. The seed of embodiment 179, wherein one or more seed treatment has been applied to the seed.

181. A method for expressing in a plant an insecticidal protein, comprising
  (a) inserting into the plant cell a nucleic acid molecule encoding an insecticidal protein of SEQ ID NO: 18 and a nucleic acid molecule encoding an insecticidal protein of SEQ ID NO: 20;
  (b) obtaining a transformed plant cell comprising the nucleic acid sequence of step (a); and
  (c) generating from the transformed plant cell a plant capable of expressing the nucleic acid molecule encoding the insecticidal proteins.

182. A transgenic plant produced by the method of embodiment 181.

183. Seed or grain of the transgenic plant of embodiment 182.

184. The transgenic plant of embodiment 182, wherein the transgenic plant further comprises one or more additional transgenic traits.

185. A transgenic plant capable of expressing at least one polynucleotide encoding a insecticidal polypeptide comprising the amino acid sequence of SEQ ID NO: 18, and a insecticidal polypeptide comprising the amino acid sequence of SEQ ID NO: 20.

186. A method for controlling an insect pest population, comprising contacting the insect pest population with an insecticidally-effective amount of a recombinant insecticidal polypeptide comprising the amino acid sequence of SEQ ID NO: 18 and a recombinant insecticidal polypeptide comprising the amino acid sequence of SEQ ID NO: 20.

187. A method of inhibiting growth or killing an insect pest, comprising contacting the insect pest with an insecticidally-effective amount of a recombinant insecticidal polypeptide comprising the amino acid sequence of SEQ ID NO: 18 and a recombinant insecticidal polypeptide comprising the amino acid sequence of SEQ ID NO: 20.

188. A method for controlling an insect pest population resistant to a pesticidal protein, comprising contacting the insect pest population with a pesticidally-effective amount of a recombinant polypeptide comprising the amino acid sequence of SEQ ID NO: 18 and a recombinant insecticidal polypeptide comprising the amino acid sequence of SEQ ID NO: 20.

189. A method for protecting a plant from an insect pest, comprising expressing in the plant or cell thereof at least one polynucleotide encoding an insecticidal polypeptide comprising the amino acid sequence of SEQ ID NO: 18 and an insecticidal polypeptide comprising the amino acid sequence of SEQ ID NO: 20.

190. A method of controlling Lepidoptera and/or Coleoptera insect infestation in a transgenic plant and providing insect resistance management, comprising expressing in the plant at least least one polynucleotide encoding at least two different insecticidal proteins having different modes of action, wherein one of the at least two insecticidal proteins comprises an insecticidal polypeptide comprising the amino acid sequence of SEQ ID NO: 18 and a recombinant insecticidal polypeptide comprising the amino acid sequence of SEQ ID NO: 20, insecticidal to insects in the order Lepidoptera and/or Coleoptera.

191. The method of embodiment 190, wherein one of the at least two insecticidal proteins comprises a Cry protein insecticidal to insects in the order Lepidoptera and/or Coleoptera.

192. A method of reducing likelihood of emergence of Lepidoptera and/or Coleoptera insect species resistance to transgenic plants expressing in the plants insecticidal proteins to control the insect species, comprising expressing at least one polynucleotide encoding a first insecticidal polypeptide comprising the amino acid sequence of SEQ ID NO: 18 and a insecticidal polypeptide comprising the amino acid sequence of SEQ ID NO: 20, insecticidal to the insect species, in combination with a second insecticidal protein having a different mode of action compared to the first insecticidal protein.

193. A means for effective Lepidoptera and/or Coleoptera insect resistance management, comprising co-expressing at high levels in transgenic plants two or more insecticidal proteins toxic to Lepidoptera and/or Coleoptera insects but each exhibiting a different mode of effectuating its killing activity, wherein one of the two or more insecticidal proteins comprise an insecticidal polypeptide comprising the amino acid sequence of SEQ ID NO: 18 and a recombinant insecticidal polypeptide comprising the amino acid sequence of SEQ ID NO: 20, and one of the two or more insecticidal proteins comprise a Cry protein.

194. A fusion protein comprising a recombinant AfIP-1A polypeptide of embodiment 35, 36, 37, 38, 39, 40, 41, 42, 43, 44, 45, 46, 47, 48 or 49.

195. A fusion protein comprising a recombinant AfIP-1B polypeptide of embodiment 98, 99, 100, 101, 102, 103, 104, 105, 106, 107, 108, 109, 110, 111, 112, 113 or 114.

196. A fusion protein comprising a recombinant AfIP-1A polypeptide of embodiment 35, 36, 37, 38, 39, 40, 41, 42, 43, 44, 45, 46, 47, 48 or 49, and a recombinant AfIP-1B polypeptide of embodiment 98, 99, 100, 101, 102, 103, 104, 105, 106, 107, 108, 109, 110, 111, 112, 113 or 114.

197. A fusion protein represented by a formula selected from the group consisting of $R^1$-L-$R^2$, $R^2$-L-$R^1$, $R^1$-$R^2$ or $R^2$-$R^1$, wherein $R^1$ is a recombinant AfIP-1A polypeptide of embodiment 35, 36, 37, 38, 39, 40, 41, 42, 43, 44, 45, 46, 47, 48, 49 or 50 or a polypeptide comprising the amino acid sequence of SEQ ID NO: 18;

$R^2$ is a recombinant AfIP-1B polypeptide of embodiment 98, 99, 100, 101, 102, 103, 104, 105, 106, 107, 108, 109, 110, 111, 112, 113 or 114 or a polypeptide comprising the amino acid sequence of SEQ ID NO: 20, and L is a linker segment.

198. The fusion protein of embodiment 197, wherein L is polypeptide linker.

199. The fusion protein of embodiment 197, wherein L is the polypeptide EEKKN (SEQ ID NO: 153).

200. The fusion protein of according to any one or more of embodiments 197, 198 or 199, wherein $R^1$ is the recombinant AfIP-1A polypeptide of SEQ ID NO: 2 or SEQ ID NO: 94 and $R^2$ is the recombinant AfIP-1B polypeptide of SEQ ID NO: 4 or SEQ ID NO: 76.

201. Use of a transgenic plant according to any one or more of embodiments 16-21, 23, 24, 29, 31-34, 79-84, 86, 92, 94-97, 115-118, 141-147, 149, 154, 156, 157, 170-175, 177, 182, 184 or 185 to derive food or feed products.

202. A process of obtaining a food or feed product comprising deriving said food or said feed product from a transgenic plant according to one or more of embodiments 16-21, 23, 24, 29, 31-34, 79-84, 86, 92, 94-97, 115-118, 141-147, 149, 154, 156, 157, 170-175, 177, 182, 184 or 185 or seed or grain thereof or progeny thereof.

203. A pesticide composition, comprising a microorganism or substance selected from at least one of:

a pesticidally active *Alcaligenes;* a microorganism, known to occupy the phytosphere of one or more plants of interest, transformed with a polynucleotide encoding an AfIP-1A polypeptide of claim 1-15 and a polynucleotide encoding the AFIP-1B polypeptide of claim 62-78;

a part or processed product of the pesticidally active *Alcaligenes*; and a part or processed product of the microorganism transformed with the polynucleotide encoding an AfIP-1A polypeptide of claim 1-15 and the polynucleotide encoding the AFIP-1B polypeptide of claim 62-78.

204. The composition of claim 203, further comprising an agriculturally suitable carrier.

205. The composition of claim 202 or 203, wherein the pesticidally active *Alcaligenes* is an *Alcaligenes faecalis* strain.

206. The composition of claim 205, wherein the *Alcaligenes faecalis* strain is DDMC P4G7 deposited under accession #NRRL B-50625.

207. The composition of claim 203 or 204, wherein the microorganism, known to occupy the phytosphere of one or more plants of interest, is a *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes, Saccharomyces, Cryptococcus, Kluyveromyces, Sporobolomyces, Rhodotorula*, and *Aureobasidium.*

208. A method for controlling a pest population, comprising contacting the pest population with the composition of claim 203, 204, 205 or 206.

209. A method of inhibiting growth or killing an insect pest, comprising contacting the insect pest with the composition of claim 203, 204, 205 or 206.

210. A method for controlling an insect pest population resistant to a pesticidal protein, comprising contacting the resistant insect pest population with the composition of claim 203, 204, 205 or 206.

211. A method for protecting a plant from a pest, comprising applying a prophylactically effective amount of the composition of claim 203, 204, 205 or 206.

212. The method of claim 208, 209, 210 or 211, wherein the composition is applied as a microbial spray.

213. The method of claim 212, wherein the microbial spray is a foliar spray.

214. The method of claim 208, 209, 210 or 211, wherein the composition is applied as a seed treatment.

215. The method of claim 214, wherein the composition, further comprises one or more seed treatment selected from a herbicide, an insecticide, a fungicide, a germination inhibitor, a germination enhancer, a plant growth regulator, a bactericide, and a nematocide.

216. The method of claim 215, wherein the composition is applied to a crop area, plant and/or soil.

217. A method for identifying Cry3A cross-resistance to insecticidal proteins, comprising screening a mCry3A resistant WCRW colony for Cry3A cross-resistance of insecticidal proteins.

BRIEF DESCRIPTION OF THE FIGURES

FIG. 1 shows the amino acid sequence alignment of AfIP-1A-31 (SEQ ID NO: 2) with Slin6118 (SEQ ID NO: 14), FGTW-51 (SEQ ID NO: 18), AfIP-1A-15554 (SEQ ID NO: 28), AfIP-1A-27066 (SEQ ID NO: 32), and AfIP-1A-33585 (SEQ ID NO: 36).

FIG. 2A-C shows the amino acid sequence alignment of AfIP-1B-32 (SEQ ID NO: 4) with Slin6117 (SEQ ID NO: 16) and FGTW-52 (SEQ ID NO: 20), AfIP-1B-15554 (SEQ ID NO: 30), AfIP-1B-27066 (SEQ ID NO: 34), and AfIP-1B-33585 (SEQ ID NO: 38).

FIG. 3A-C shows the amino acid sequence alignment of: AfIP-1A-31 (SEQ ID NO: 2); closely related *Alcaligenes faecalis* active orthologs; AfIP-1A-15554 (SEQ ID NO: 22), AfIP-1A-27066 (SEQ ID NO: 26); and AfIP-1A-33585 (SEQ ID NO: 30); the distantly related active homolog FGTW-51 (SEQ ID NO: 18); and the distantly related aegerolysin-like proteins: Slin6118_GI_284040949_Aegerolysin_S_linguale (SEQ ID NO: 14), GI_115390458_A_terreus (SEQ ID NO: 124), GI_119487614_N_fischeri (SEQ ID NO: 125), GI_121709507_A_clavatus (SEQ ID NO: 126), GI_145230219_A_niger (SEQ ID NO: 127), GI_145256342_A_niger (SEQ ID NO: 128), GI_152985646_P_aeruginosa_aegerolysin (SEQ ID NO: 130), GI_15595320_P_aeruginosa (SEQ ID NO: 131), GI_158524422_R_australe (SEQ ID NO: 132), GI_169772307_A_oryzae (SEQ ID NO: 133), GI_169777319_A_oryzae (SEQ ID NO: 134), GI_169785219_A_oryzae (SEQ ID NO: 135), GI_186897694_H_annosum (SEQ ID NO: 136), GI_2292820_C_bifermentans (SEQ ID NO: 137), GI_2292821_C_bifermentans (SEQ ID NO: 138), GI_24636240_A_aegerita_Aegerolysin (SEQ ID NO: 139), GI_26112720_B_vulgaris (SEQ ID NO: 140), GI_46507636_L_multiflorum (SEQ ID NO: 141), GI_54312022_P_ostreatus_pleurotolysin (SEQ ID NO: 142), GI_60461919_P_ostretus_ostreolysin(SEQ ID NO: 143), GI_67522192_A_nidulans (SEQ ID NO: 144), GI_70985747_A_fumigatus_hemolysin (SEQ ID NO: 145), GI_90639437_T_versicolor (SEQ ID NO: 146), and GI_238581050_M_perniciosa (SEQ ID NO: 147. Motif 1 (a.a. 15-26), motif 2 (a.a. 33-53), motif 3 (a.a. 71-84), and motif 4 (a.a 100-107) of SEQ ID NO: 2 are underlined.

FIG. 4 shows the amino acid sequence alignment of AfIP-1B-32 (SEQ ID NO: 4) and FGTW-52 (SEQ ID NO: 20) and the correspondence of amino acids of SEQ ID NO: 20 with the amino acids of SEQ ID NO: 4.

FIG. 5 shows the amino acid sequence alignment of AfIP-1A-31 (SEQ ID NO: 2), FGTW-51 (SEQ ID NO: 18), Slin6118_GI_284040949_Aegerolysin_S_linguale (SEQ ID NO: 14); and the Cry34-like proteins: Cry34Aa2_AAK64560 (SEQ ID NO: 119), Cry34Ab1_AAG41671 (SEQ ID NO: 120), Cry34Ac1_AAG50118 (SEQ ID NO: 121), Cry34Ac2_AAK64562 (SEQ ID NO: 122), Cry34Ba1_AAK64566 (SEQ ID NO: 123), GI_49175503_Bt_Cry34A_like (SEQ ID NO: 148).

FIG. 6 shows the amino acid sequence alignment of AfIP-1A-31 (SEQ ID NO: 2), FGTW-51 (SEQ ID NO: 18), Slin6118_GI_284040949Aegerolysin_S_linguale (SEQ ID NO: 14) and the Cry3A protein of SEQ ID NO: 276.

FIG. 7 shows the amino acid sequence alignment of AfIP-1B-32 (SEQ ID NO: 4) and the Cry3A protein of SEQ ID NO: 276.

DETAILED DESCRIPTION

Figure 8:
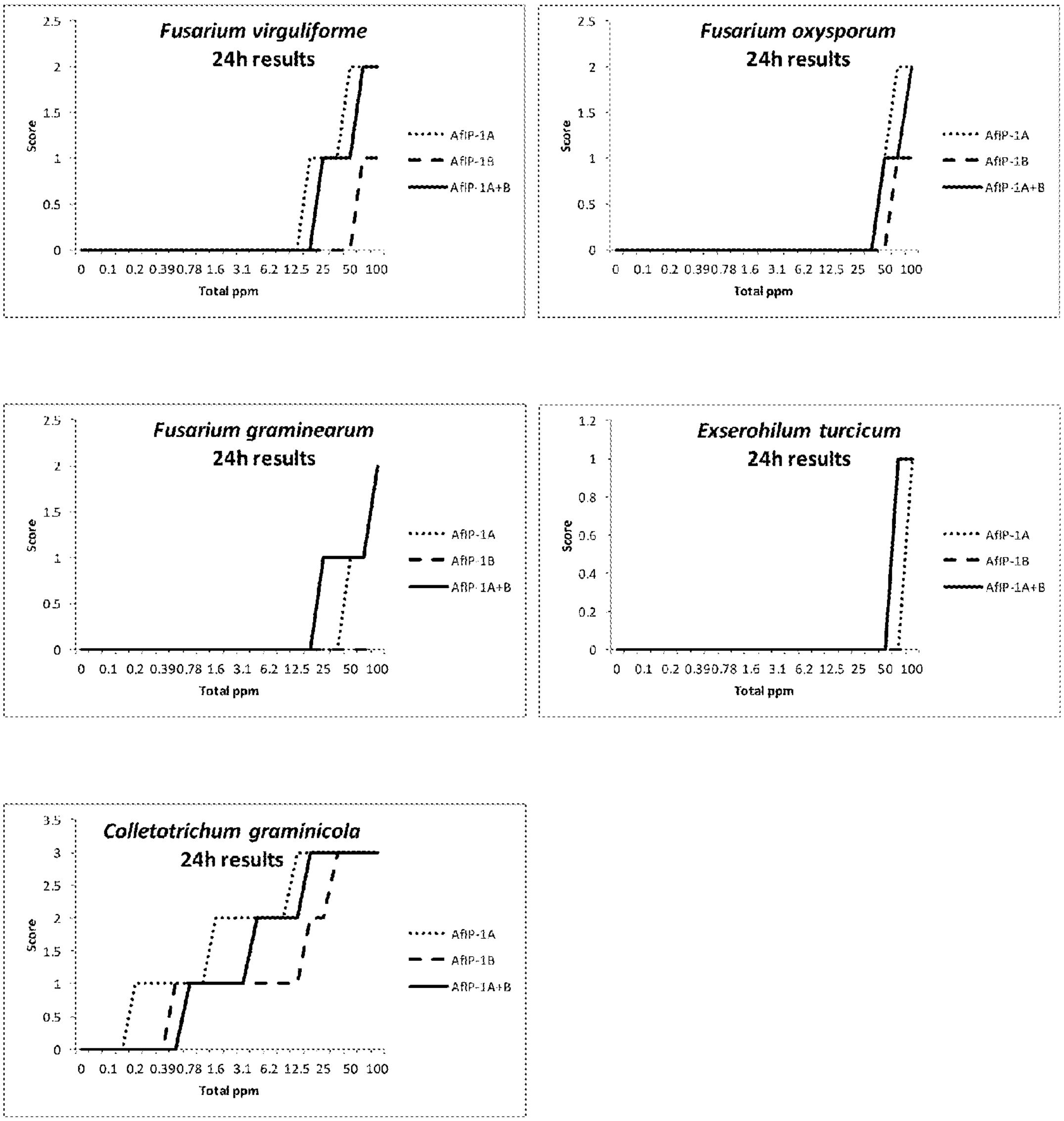
FIG. 8 shows the antifungal activity of AfIP-1A-31 (SEQ ID NO: 2) and AfIP-1B-32 (SEQ ID NO: 4) alone and together against the fungal pathogens *Fusarium virguliforme* (FVR), *Fusarium oxysporum* (FOS), *Fusarium graminearum* (FGR), *Colletotrichum graminicola* (CGR), and *Exserohilum turcicum* (ETC).

It is to be understood that this invention is not limited to the particular methodology, protocols, cell lines, genera, and reagents described, as such may vary. It is also to be understood that the terminology used herein is for the purpose of describing particular embodiments only, and is not intended to limit the scope of the present invention.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this invention belongs unless clearly indicated otherwise.

The present disclosure is drawn to compositions and methods for controlling pests. The methods involve transforming organisms with nucleic acid sequences encoding an AfIP-1A and/or AfIP-1B polypeptides. In particular, the nucleic acid sequences of the embodiments are useful for preparing plants and microorganisms that possess pesticidal activity. Thus, transformed bacteria, plants, plant cells, plant tissues and seeds are provided. The compositions are pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered AfIP-1A and AfIP-1B polypeptides by methods known in the art, such as site directed mutagenesis, domain swapping or DNA shuffling. The AfIP-1A and AfIP-1B polypeptides find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas* protegens strain CHA0 and Pf-5 (previously fluorescens) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.*, 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal,* 3:101-118 and Morgan, et al., (2001) *Applied and Envir. Micro.* 67:2062-2069); U.S. Pat. No. 6,048,838, and U.S. Pat. Nos. 6,379,946; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51 and Cry55 classes of δ-endotoxin genes and the *B. thuringiensis* cytolytic cyt1 and cyt2 genes. Members of these classes of *B. thuringiensis* insecticidal proteins include, but are not limited to Cry1Aa1 (Accession #M11250), Cry1Aa2 (Accession #M10917), Cry1Aa3 (Accession #D00348), Cry1Aa4 (Accession #X13535), Cry1Aa5 (Accession #D17518), Cry1Aa6 (Accession #U43605), Cry1Aa7 (Accession #AF081790), Cry1Aa8

(Accession #I26149), Cry1Aa9 (Accession #AB026261), Cry1Aa10 (Accession #AF154676), Cry1Aa11 (Accession #Y09663), Cry1Aa12 (Accession #AF384211), Cry1Aa13 (Accession #AF510713), Cry1Aa14 (Accession #AY197341), Cry1Aa15 (Accession #DQ062690), Cry1Ab1 (Accession #M13898), Cry1Ab2 (Accession #M12661), Cry1Ab3 (Accession #M15271), Cry1Ab4 (Accession #D00117), Cry1Ab5 (Accession #X04698), Cry1Ab6 (Accession #M37263), Cry1Ab7 (Accession #X13233), Cry1Ab8 (Accession #M16463), Cry1Ab9 (Accession #X54939), Cry1Ab10 (Accession #A29125), Cry1Ab11 (Accession #I12419), Cry1Ab12 (Accession #AF059670), Cry1Ab13 (Accession #AF254640), Cry1Ab14 (Accession #U94191), Cry1Ab15 (Accession #AF358861), Cry1Ab16 (Accession #AF375608), Cry1Ab17 (Accession #AAT46415), Cry1Ab18 (Accession #AAQ88259), Cry1Ab19 (Accession #AY847289), Cry1Ab20 (Accession #DQ241675), Cry1Ab21 (Accession #EF683163), Cry1Ab22 (Accession #ABW87320), Cry1Ab-like (Accession #AF327924), Cry1Ab-like (Accession #AF327925), Cry1Ab-like (Accession #AF327926), Cry1Ab-like (Accession #DQ781309), Cry1Ac1 (Accession #M11068), Cry1Ac2 (Accession #M35524), Cry1Ac3 (Accession #X54159), Cry1Ac4 (Accession #M73249), Cry1Ac5 (Accession #M73248), Cry1Ac6 (Accession #U43606), Cry1Ac7 (Accession #U87793), Cry1Ac8 (Accession #U87397), Cry1Ac9 (Accession #U89872), Cry1Ac10 (Accession #AJ002514), Cry1Ac11 (Accession #AJ130970), Cry1Ac12 (Accession #I12418), Cry1Ac13 (Accession #AF148644), Cry1Ac14 (Accession #AF492767), Cry1Ac15 (Accession #AY122057), Cry1Ac16 (Accession #AY730621), Cry1Ac17 (Accession #AY925090), Cry1Ac18 (Accession #DQ023296), Cry1Ac19 (Accession #DQ195217), Cry1Ac20 (Accession #DQ285666), Cry1Ac21 (Accession #DQ062689), Cry1Ac22 (Accession #EU282379), Cry1Ac23 (Accession #AM949588), Cry1Ac24 (Accession #ABL01535), Cry1Ad1 (Accession #M73250), Cry1Ad2 (Accession #A27531), Cry1Ae1 (Accession #M65252), Cry1Af1 (Accession #U82003), Cry1Ag1 (Accession #AF081248), Cry1Ah1 (Accession #AF281866), Cry1Ah2 (Accession #DQ269474), Cry1Ai1 (Accession #AY174873), Cry1A-like (Accession #AF327927), Cry1Ba1 (Accession #X06711), Cry1Ba2 (Accession #X95704), Cry1Ba3 (Accession #AF368257), Cry1Ba4 (Accession #AF363025), Cry1Ba5 (Accession #AB020894), Cry1Ba6 (Accession #ABL60921), Cry1Bb1 (Accession #L32020), Cry1Bc1 (Accession #Z46442), Cry1Bd1 (Accession #U70726), Cry1Bd2 (Accession #AY138457), Cry1Be1 (Accession #AF077326), Cry1Be2 (Accession #AAQ52387), Cry1Bf1 (Accession #AX189649), Cry1Bf2 (Accession #AAQ52380), Cry1Bg1 (Accession #AY176063), Cry1Ca1 (Accession #X07518), Cry1Ca2 (Accession #X13620), Cry1Ca3 (Accession #M73251), Cry1Ca4 (Accession #A27642), Cry1Ca5 (Accession #X96682), Cry1Ca6 [1] (Accession #AF215647), Cry1Ca7 (Accession #AY015492), Cry1Ca8 (Accession #AF362020), Cry1Ca9 (Accession #AY078160), Cry1Ca10 (Accession #AF540014), Cry1Ca11 (Accession #AY955268), Cry1Cb1 (Accession #M97880), Cry1Cb2 (Accession #AY007686), Cry1Cb3 (Accession #EU679502), Cry1Cb-like (Accession #AAX63901), Cry1Da1 (Accession #X54160), Cry1Da2 (Accession #I76415), Cry1Db1 (Accession #Z22511), Cry1 Db2 (Accession #AF358862), Cry1 Dc1 (Accession #EF059913), Cry1Ea1 (Accession #X53985), Cry1Ea2 (Accession #X56144), Cry1Ea3 (Accession #M73252), Cry1Ea4 (Accession #U94323), Cry1Ea5 (Accession #A15535), Cry1Ea6 (Accession #AF202531), Cry1 Ea7 (Accession #AAW72936), Cry1 Ea8 (Accession #ABX11258), Cry1Eb1 (Accession #M73253), Cry1Fa1 (Accession #M63897), Cry1Fa2 (Accession #M73254), Cry1Fb1 (Accession #Z22512), Cry1Fb2 (Accession #AB012288), Cry1Fb3 (Accession #AF062350), Cry1Fb4 (Accession #I73895), Cry1Fb5 (Accession #AF336114), Cry1Fb6 (Accession #EU679500), Cry1Fb7 (Accession #EU679501), Cry1Ga1 (Accession #Z22510), Cry1Ga2 (Accession #Y09326), Cry1Gb1 (Accession #U70725), Cry1Gb2 (Accession #AF288683), Cry1Gc (Accession #AAQ52381), Cry1Ha1 (Accession #Z22513), Cry1Hb1 (Accession #U35780), Cry1H-like (Accession #AF182196), Cry1Ia1 (Accession #X62821), Cry1Ia2 (Accession #M98544), Cry1Ia3 (Accession #L36338), Cry1Ia4 (Accession #L49391), Cry1Ia5 (Accession #Y08920), Cry1Ia6 (Accession #AF076953), Cry1Ia7 (Accession #AF278797), Cry1Ia8 (Accession #AF373207), Cry1Ia9 (Accession #AF521013), Cry1Ia10 (Accession #AY262167), Cry1Ia11 (Accession #AJ315121), Cry1Ia12 (Accession #AAV53390), Cry1Ia13 (Accession #ABF83202), Cry1Ia14 (Accession #EU887515), Cry1Ib1 (Accession #U07642), Cry1Ib2 (Accession #ABW88019), Cry1Ib3 (Accession #EU677422), Cry1Ic1 (Accession #AF056933), Cry1Ic2 (Accession #AAE71691), Cry1Id1 (Accession #AF047579), Cry1Ie1 (Accession #AF211190), Cry1If1 (Accession #AAQ52382), Cry1I-like (Accession #I90732), Cry1I-like (Accession #DQ781310), Cry1Ja1 (Accession #L32019), Cry1Jb1 (Accession #U31527), Cry1Jc1 (Accession #I90730), Cry1Jc2 (Accession #AAQ52372), Cry1Jd1 (Accession #AX189651), Cry1Ka1 (Accession #U28801), Cry1La1 (Accession #AAS60191), Cry1-like (Accession #I90729), Cry2Aa1 (Accession #M31738), Cry2Aa2 (Accession #M23723), Cry2Aa3 (Accession #D86064), Cry2Aa4 (Accession #AF047038), Cry2Aa5 (Accession #AJ132464), Cry2Aa6 (Accession #AJ132465), Cry2Aa7 (Accession #AJ132463), Cry2Aa8 (Accession #AF252262), Cry2Aa9 (Accession #AF273218), Cry2Aa10 (Accession #AF433645), Cry2Aa11 (Accession #AAQ52384), Cry2Aa12 (Accession #DQ977646), Cry2Aa13 (Accession #ABL01536), Cry2Aa14 (Accession #ACF04939), Cry2Ab1 (Accession #M23724), Cry2Ab2 (Accession #X55416), Cry2Ab3 (Accession #AF164666), Cry2Ab4 (Accession #AF336115), Cry2Ab5 (Accession #AF441855), Cry2Ab6 (Accession #AY297091), Cry2Ab7 (Accession #DQ119823), Cry2Ab8 (Accession #DQ361266), Cry2Ab9 (Accession #DQ341378), Cry2Ab10 (Accession #EF157306), Cry2Ab11 (Accession #AM691748), Cry2Ab12 (Accession #ABM21764), Cry2Ab13 (Accession #EU909454), Cry2Ab14 (Accession #EU909455), Cry2Ac1 (Accession #X57252), Cry2Ac2 (Accession #AY007687), Cry2Ac3 (Accession #AAQ52385), Cry2Ac4 (Accession #DQ361267), Cry2Ac5 (Accession #DQ341379), Cry2Ac6 (Accession #DQ359137), Cry2Ac7 (Accession #AM292031), Cry2Ac8 (Accession #AM421903), Cry2Ac9 (Accession #AM421904), Cry2Ac10 (Accession #BI 877475), Cry2Ac11 (Accession #AM689531), Cry2Ac12 (Accession #AM689532), Cry2Ad1 (Accession #AF200816), Cry2Ad2 (Accession #DQ358053), Cry2Ad3 (Accession #AM268418), Cry2Ad4 (Accession #AM490199), Cry2Ad5 (Accession #AM765844), Cry2Ae1 (Accession #AAQ52362), Cry2Af1 (Accession #EF439818), Cry2Ag (Accession #ACH91610), Cry2Ah (Accession #EU939453), Cry3Aa1 (Accession #M22472), Cry3Aa2 (Accession #J02978), Cry3Aa3 (Accession #Y00420), Cry3Aa4 (Accession #M30503), Cry3Aa5 (Accession

#M37207), Cry3Aa6 (Accession #U10985), Cry3Aa7 (Accession #AJ237900), Cry3Aa8 (Accession #AAS79487), Cry3Aa9 (Accession #AAW05659), Cry3Aa10 (Accession #AAU29411), Cry3Aa11 (Accession #AY882576), Cry3Aa12 (Accession #ABY49136), Cry3Ba1 (Accession #X17123), Cry3Ba2 (Accession #A07234), Cry3Bb1 (Accession #M89794), Cry3Bb2 (Accession #U31633), Cry3Bb3 (Accession #I15475), Cry3Ca1 (Accession #X59797), Cry4Aa1 (Accession #Y00423), Cry4Aa2 (Accession #D00248), Cry4Aa3 (Accession #AL731825), Cry4A-like (Accession #DQ078744), Cry4Ba1 (Accession #X07423), Cry4Ba2 (Accession #X07082), Cry4Ba3 (Accession #M20242), Cry4Ba4 (Accession #D00247), Cry4Ba5 (Accession #AL731825), Cry4Ba-like (Accession #ABC47686), Cry4Ca1 (Accession #EU646202), Cry5Aa1 (Accession #L07025), Cry5Ab1 (Accession #L07026), Cry5Ac1 (Accession #I34543), Cry5Ad1 (Accession #EF219060), Cry5Ba1 (Accession #U19725), Cry5Ba2 (Accession #EU121522), Cry6Aa1 (Accession #L07022), Cry6Aa2 (Accession #AF499736), Cry6Aa3 (Accession #DQ835612), Cry6Ba1 (Accession #L07024), Cry7Aa1 (Accession #M64478), Cry7Ab1 (Accession #U04367), Cry7Ab2 (Accession #U04368), Cry7Ab3 (Accession #BI 1015188), Cry7Ab4 (Accession #EU380678), Cry7Ab5 (Accession #ABX79555), Cry7Ab6 (Accession #FJ194973), Cry7Ba1 (Accession #ABB70817), Cry7Ca1 (Accession #EF486523), Cry8Aa1 (Accession #U04364), Cry8Ab1 (Accession #EU044830), Cry8Ba1 (Accession #U04365), Cry8Bb1 (Accession #AX543924), Cry8Bc1 (Accession #AX543926), Cry8Ca1 (Accession #U04366), Cry8Ca2 (Accession #AAR98783), Cry8Ca3 (Accession #EU625349), Cry8Da1 (Accession #AB089299), Cry8Da2 (Accession #BD133574), Cry8Da3 (Accession #BD133575), Cry8 Db1 (Accession #AB303980), Cry8Ea1 (Accession #AY329081), Cry8Ea2 (Accession #EU047597), Cry8Fa1 (Accession #AY551093), Cry8Ga1 (Accession #AY590188), Cry8Ga2 (Accession #DQ318860), Cry8Ga3 (Accession #FJ198072), Cry8Ha1 (Accession #EF465532), Cry81a1 (Accession #EU381044), Cry8Ja1 (Accession #EU625348), Cry8 like (Accession #ABS53003), Cry9Aa1 (Accession #X58120), Cry9Aa2 (Accession #X58534), Cry9Aa like (Accession #AAQ52376), Cry9Ba1 (Accession #X75019), Cry9Bb1 (Accession #AY758316), Cry9Ca1 (Accession #Z37527), Cry9Ca2 (Accession #AAQ52375), Cry9Da1 (Accession #D85560), Cry9Da2 (Accession #AF042733), Cry9 Db1 (Accession #AY971349), Cry9Ea1 (Accession #AB011496), Cry9Ea2 (Accession #AF358863), Cry9Ea3 (Accession #EF157307), Cry9Ea4 (Accession #EU760456), Cry9Ea5 (Accession #EU789519), Cry9Ea6 (Accession #EU887516), Cry9Eb1 (Accession #AX189653), Cry9Ec1 (Accession #AF093107), Cry9Ed1 (Accession #AY973867), Cry9 like (Accession #AF093107), Cry10Aa1 (Accession #M12662), Cry10Aa2 (Accession #E00614), Cry10Aa3 (Accession #AL731825), Cry10A like (Accession #DQ167578), Cry1lAa1 (Accession #M31737), Cry11Aa2 (Accession #M22860), Cry11Aa3 (Accession #AL731825), Cry1lAa-like (Accession #DQ166531), Cry11Ba1 (Accession #X86902), Cry11Bb1 (Accession #AF017416), Cry12Aa1 (Accession #L07027), Cry13Aa1 (Accession #L07023), Cry14Aa1 (Accession #U13955), Cry15Aa1 (Accession #M76442), Cry16Aa1 (Accession #X94146), Cry17Aa1 (Accession #X99478), Cry18Aa1 (Accession #X99049), Cry18Ba1 (Accession #AF169250), Cry18Ca1 (Accession #AF169251), Cry19Aa1 (Accession #Y07603), Cry19Ba1 (Accession #D88381), Cry20Aa1 (Accession #U82518), Cry21Aa1 (Accession #I32932), Cry21Aa2 (Accession #I66477), Cry21Ba1 (Accession #AB088406), Cry22Aa1 (Accession #134547), Cry22Aa2 (Accession #AX472772), Cry22Aa3 (Accession #EU715020), Cry22Ab1 (Accession #AAK50456), Cry22Ab2 (Accession #AX472764), Cry22Ba1 (Accession #AX472770), Cry23Aa1 (Accession #AAF76375), Cry24Aa1 (Accession #U88188), Cry24Ba1 (Accession #BAD32657), Cry24Ca1 (Accession #AM158318), Cry25Aa1 (Accession #U88189), Cry26Aa1 (Accession #AF122897), Cry27Aa1 (Accession #AB023293), Cry28Aa1 (Accession #AF132928), Cry28Aa2 (Accession #AF285775), Cry29Aa1 (Accession #AJ251977), Cry30Aa1 (Accession #AJ251978), Cry30Ba1 (Accession #BAD00052), Cry30Ca1 (Accession #BAD67157), Cry30Da1 (Accession #EF095955), Cry30 Db1 (Accession #BAE80088), Cry30Ea1 (Accession #EU503140), Cry30Fa1 (Accession #EU751609), Cry30Ga1 (Accession #EU882064), Cry31Aa1 (Accession #AB031065), Cry31Aa2 (Accession #AY081052), Cry31Aa3 (Accession #AB250922), Cry31Aa4 (Accession #AB274826), Cry31Aa5 (Accession #AB274827), Cry31Ab1 (Accession #AB250923), Cry31Ab2 (Accession #AB274825), Cry31Ac1 (Accession #AB276125), Cry32Aa1 (Accession #AY008143), Cry32Ba1 (Accession #BAB78601), Cry32Ca1 (Accession #BAB78602), Cry32Da1 (Accession #BAB78603), Cry33Aa1 (Accession #AAL26871), Cry34Aa1 (Accession #AAG50341), Cry34Aa2 (Accession #AAK64560), Cry34Aa3 (Accession #AY536899), Cry34Aa4 (Accession #AY536897), Cry34Ab1 (Accession #AAG41671), Cry34Ac1 (Accession #AAG50118), Cry34Ac2 (Accession #AAK64562), Cry34Ac3 (Accession #AY536896), Cry34Ba1 (Accession #AAK64565), Cry34Ba2 (Accession #AY536900), Cry34Ba3 (Accession #AY536898), Cry35Aa1 (Accession #AAG50342), Cry35Aa2 (Accession #AAK64561), Cry35Aa3 (Accession #AY536895), Cry35Aa4 (Accession #AY536892), Cry35Ab1 (Accession #AAG41672), Cry35Ab2 (Accession #AAK64563), Cry35Ab3 (Accession #AY536891), Cry35Ac1 (Accession #AAG50117), Cry35Ba1 (Accession #AAK64566), Cry35Ba2 (Accession #AY536894), Cry35Ba3 (Accession #AY536893), Cry36Aa1 (Accession #AAK64558), Cry37Aa1 (Accession #AAF76376), Cry38Aa1 (Accession #AAK64559), Cry39Aa1 (Accession #BAB72016), Cry40Aa1 (Accession #BAB72018), Cry40Ba1 (Accession #BAC77648), Cry40Ca1 (Accession #EU381045), Cry40Da1 (Accession #EU596478), Cry41Aa1 (Accession #AB116649), Cry41Ab1 (Accession #AB116651), Cry42Aa1 (Accession #AB116652), Cry43Aa1 (Accession #AB115422), Cry43Aa2 (Accession #AB176668), Cry43Ba1 (Accession #AB115422), Cry43-like (Accession #AB115422), Cry44Aa (Accession #BAD08532), Cry45Aa (Accession #BAD22577), Cry46Aa (Accession #BAC79010), Cry46Aa2 (Accession #BAG68906), Cry46Ab (Accession #BAD35170), Cry47Aa (Accession #AY950229), Cry48Aa (Accession #AJ841948), Cry48Aa2 (Accession #AM237205), Cry48Aa3 (Accession #AM237206), Cry48Ab (Accession #AM237207), Cry48Ab2 (Accession #AM237208), Cry49Aa (Accession #AJ841948), Cry49Aa2 (Accession #AM237201), Cry49Aa3 (Accession #AM237203), Cry49Aa4 (Accession #AM237204), Cry49Ab1 (Accession #AM237202), Cry50Aa1 (Accession #AB253419), Cry51Aa1 (Accession #DQ836184), Cry52Aa1 (Accession #EF613489), Cry53Aa1 (Accession #EF633476), Cry54Aa1 (Accession #EU339367), Cry55Aa1 (Accession #EU121521), Cry55Aa2 (Accession #AAE33526) Cyt1Aa (GenBank Accession Number X03182), Cyt1Ab (GenBank Accession Number X98793), Cyt1B (GenBank Accession Number U37196), Cyt2A (GenBank Accession Number Z14147), Cyt2B (GenBank Accession Number U52043).

Examples of δ-endotoxins also include but are not limited to Cry1A proteins of U.S. Pat. Nos. 5,880,275 and 7,858, 849; a DIG-3 or DIG-11 toxin (N-terminal deletion of α-helix 1 and/or α-helix 2 variants of cry proteins such as Cry1A, Cry3A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families; a Cry15 protein of Naimov, et al., (2008) *Applied and Environmental Microbiology,* 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949, 626, 7,385,107 and 7,504,229; a CryET33 and CryET34 homologs of US Patent Publication Number 2006/0191034, 2012/0278954, and PCT Publication Number WO 2012/ 139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/ 021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/ 0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/ index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/ 0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615, 686, and 8,237,020 and the like. Other VIP proteins are well known to one skilled in the art (see, lifesci.sussex.ac.uk/ home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084, 418). Some TC proteins have "stand alone" insecticidal activity and other TC proteins enhance the activity of the stand-alone toxins produced by the same given organism.

The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the AfIP-1A and AfIP-1B polypeptides include amino acid sequences deduced from the full-length nucleic acid sequences disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of AfIP-1A and AfIP-1B polypeptides. The protein resulting from translation of these AfIP-1A and AfIP-1B polypeptide genes allows cells to control or kill pests that ingest it.

Bacterial Strains

One aspect pertains to bacterial strains that express an AfIP-1A polypeptide and/or AfIP-1B polypeptide. In some embodiments the bacterial strain is an *Alcaligenes faecalis* strain. In some embodiments the bacterial strain is a biologically pure culture of an *Alcaligenes faecalis* strain SS44C4, deposited on Dec. 1, 2011 under accession number NRRLB-50613 with the Agricultural Research Service Culture Collection (NRRL).

Nucleic Acid Molecules, and Variants and Fragments Thereof

One aspect pertains to isolated or recombinant nucleic acid molecules comprising nucleic acid sequences encoding AfIP-1A and AfIP-1B polypeptides or biologically active portions thereof, as well as nucleic acid molecules sufficient for use as hybridization probes to identify nucleic acid molecules encoding proteins with regions of sequence homology. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" or "recombinant" nucleic acid molecule (or DNA) is used herein to refer to a nucleic acid sequence (or DNA) that is no longer in its natural environment, for example in an in vitro or in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding an AfIP-1A and/or AfIP-1B polypeptide can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

A variety of polynucleotides that encode an AfIP-1A and/or AfIP-1B polypeptides or related proteins are contemplated. Such polynucleotides are useful for production of AfIP-1A and/or AfIP-1B polypeptides in host cells when operably linked to suitable promoter, transcription termination and/or polyadenylation sequences. Such polynucleotides are also useful as probes for isolating homologous or substantially homologous polynucleotides that encode AfIP-1A and/or AfIP-1B polypeptides or related proteins.

One source of polynucleotides that encode AfIP-1A and/or AfIP-1B polypeptides or related proteins is an *Alcaligenes faecalis* strain which contains the AfIP-1A polynucleotide of SEQ ID NO: 1 encoding the AfIP-1A polypeptide of SEQ ID NO: 2 and/or the AfIP-1B polynucleotide of SEQ ID NO: 3 encoding the AfIP-1B polypeptide of SEQ ID NO: 4. These polynucleotide sequences were isolated from a *Alcaligenes faecalis* host and are thus suitable for expression of the encoded AfIP-1A and/or AfIP-1B polypeptide in other bacterial hosts. For example, SEQ ID NO: 1 and SEQ ID NO: 3 can be used to express AfIP-1A and AfIP-1B proteins in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode AfIP-1A and/or AfIP-1B polypeptides or related proteins. Such probes can be used to identify homologous or substantially homologous polynucleotides derived from *Alcaligenes* or other related bacteria.

Polynucleotides that encode an AfIP-1A and/or AfIP-1B polypeptide can also be synthesized de novo from an AfIP-1A and/or AfIP-1B polypeptide sequence. The sequence of the polynucleotide gene can be deduced from an AfIP-1A and/or AfIP-1B polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of AfIP-1A and/or AfIP-1B polypeptide sequences that can be used to obtain corresponding nucleotide encoding sequences include, but are not limited to, the AfIP-1A polypeptide of sequence SEQ ID NO: 2 and the AfIP-1B polypeptide of sequence SEQ ID NO: 4. Furthermore, synthetic AfIP-1A and/or AfIP-1B polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding an AfIP-1A polypeptide is a polynucleotide having the sequence set forth in SEQ ID NO: 1, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide. In some embodiments the nucleic acid molecule encoding an AfIP-1B polypeptide is a nucleic acid molecule having the sequence set forth in SEQ ID NO: 3. The corresponding amino acid sequences for the AfIP-1A and AfIP-1B polypeptides encoded by these nucleic acid sequences are set forth in SEQ ID NO: 2 and SEQ ID NO: 4, respectively.

In some embodiments the nucleic acid molecule encoding an AfIP-1A polypeptide is a polynucleotide having a nucleotide sequence encoding a polypeptide comprising an amino acid sequence having at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity, to the amino acid sequence of SEQ ID NO: 2, wherein the polypeptide has pesticidal activity.

In some embodiments the nucleic acid molecule encoding an AfIP-1A polypeptide is a polynucleotide having a nucleotide sequence encoding a polypeptide comprising an amino acid sequence of SEQ ID NO: 255, wherein Xaa at position 6 is Ile or Thr; Xaa at position 7 is Ala or Val; Xaa at position 9 is Glu or Gly; Xaa at position 13 is Ile or Val; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr or Ala; Xaa at position 24 is Ile or Leu; Xaa at position 30 is Asn or Ser; Xaa at position 33 is Val or Ile; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Leu or Phe; Xaa at position 51 is Lys, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Leu or Phe; Xaa at position 56 is Ser or Leu; Xaa at position 57 is Gln, Glu, Leu or Phe; Xaa at position 58 is Ile, Val, Leu or Phe; Xaa at position 60 is Gly, Leu of Phe; Xaa at position 61 is Thr, Ile or Phe; Xaa at position 62 is Ile, Val, Leu or Phe; Xaa at position 64 is Lys, Glu, Leu or Phe; Xaa at position 65 is Asp, Leu or Phe; Xaa at position 67 is Asp or Glu; Xaa at position 68 is Ser or Thr; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 82 is Gly, Glu, Asn, Trp or Tyr; Xaa at position 96 is Val or Ile; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 111 is Asp or Asn; Xaa at position 113 is Leu or Ser; Xaa at position 115 is Val or Ile; Xaa at position 116 is Lys or Glu; Xaa at position 120 is Asn or Lys; Xaa at position 121 is Tyr, Leu or Phe; Xaa at position 122 is Thr, Leu or Phe; Xaa at position 123 is Val, Leu, Phe or Asn; Xaa at position 124 is Ile, Ser, Leu or Phe; Xaa at position 125 is Lys, Leu, Phe or Met; Xaa at position 126 is Lys, Leu or Phe; Xaa at position 128 is Gly, Leu or Phe; Xaa at position 129 is Gly, Leu or Phe; Xaa at position 130 is Ser, Leu or Phe; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; and Xaa at position 140 is Ile, Ala, Cys, Phe, His, Leu, Met, Asn, Gln, Thr, Val or Tyr and wherein, 1 to 14 amino acids are optionally deleted from the N-terminus of the polypeptide.

In some embodiments the nucleic acid molecule encoding an AfIP-1A polypeptide is a polynucleotide having a nucleotide sequence encoding a polypeptide comprising an amino acid sequence of SEQ ID NO: 256, wherein Xaa at position 6 is Ile or Thr; Xaa at position 7 is Ala, Met or Val; Xaa at position 8 is Thr or Asp; Xaa at position 9 is Glu, Leu or Gly; Xaa at position 10 is Glu or Asn; Xaa at position 11 is Ser or Val; Xaa at position 12 is Lys or Glu; Xaa at position 13 is Ile or Val; Xaa at position 14 is Arg or Gln; Xaa at position 16 is Tyr or Gln; Xaa at position 17 is Ala or Ser; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu or Ala; Xaa at position 24 is Ile or Leu; Xaa at position 26 is Val or Ser; Xaa at position 27 is Val or Glu; Xaa at position 29 is Ser or Met; Xaa at position 30 is Asn, Asp or Ser; Xaa at position 31 is Phe or Ile; Xaa at position 32 is Lys or Glu; Xaa at position 33 is Val or Ile; Xaa at position 34 is Glu or Lys; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Ser, Leu or Phe; Xaa at position 51 is Lys, Asn, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Leu or Phe; Xaa at position 56 is Ser, Asp or Leu; Xaa at position 57 is Gln, Thr, Glu, Leu or Phe; Xaa at position 58 is Ile, Val, Leu or Phe; Xaa at position 60 is Gly, Lys, Leu or Phe; Xaa at position 61 is Thr, Ile or Phe; Xaa at position 62 is Ile, Lys, Val, Leu or Phe; Xaa at position 64 is Lys, Ser, Glu, Leu or Phe; Xaa at position 65 is Asp, Ser, Leu or Phe; Xaa at position 66 is Glu or Gly; Xaa at position 67 is Asp, Thr or Glu; Xaa at position 68 is Ser, Lys or Thr; Xaa at position 69 is Tyr or Ser; Xaa at position 70 is Thr or Lys; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu or Ala; Xaa at position 78 is Asn or Asp; Xaa at position 79 is Ala or Thr; Xaa at position 82 is Gly, Glu, Asn, Trp or Tyr; Xaa at position 86 is Gly or Lys; Xaa at position 88 is Ser or Glu; Xaa at position 89 is Leu or Ile; Xaa at position 91 is Asp or His; Xaa at position 92 is Gly or Asp; Xaa at position 95 is Leu or Trp; Xaa at position 96 is Val, Leu or Ile; Xaa at position 97 is Phe or Ala; Xaa at position 98 is Glu or Thr; Xaa at position 100 is Tyr or Lys; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser or Ala; Xaa at position 111 is Asp, His or Asn; Xaa at position 112 is Glu or Ser; Xaa at position 113 is Leu or Ser; Xaa at position 114 is Thr or Ser; Xaa at position 115 is Val or Ile; Xaa at position 116 is Lys, Thr or Glu; Xaa at position 117 is Asp or Glu; Xaa at position 118 is Lys or Asp; Xaa at position 119 is Glu or Asn; Xaa at position 120 is Asn or Lys; Xaa at position 121 is Tyr, Leu or Phe; Xaa at position 122 is Thr, Lys, Leu or Phe; Xaa at position 123 is Val, Ile, Leu, Phe or Asn; Xaa at position 124 is Ile, Ser, Asp, Leu or Phe; Xaa at position 125 is Lys, Leu, Phe or Met; Xaa at position 126 is Lys, Glu, Leu or Phe; Xaa at position 128 is Gly, Leu or Phe; Xaa at position 129 is Gly, Asn, Leu or Phe; Xaa at position 130 is Ser, Ile, Leu or Phe; Xaa at position 131 is Pro or Ser; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val or Cys; Xaa at position 143 is Val or Ile; Xaa at position 145 is Lys or Val; and Xaa at position 146 is Ser or Gly; and wherein, 1 to 14 amino acids are optionally deleted from the N-terminus of the polypeptide.

In some embodiments the nucleic acid molecule encoding an AfIP-1A polypeptide is a polynucleotide having a nucleotide sequence encoding a polypeptide comprising an amino acid sequence of SEQ ID NO: 257 wherein Xaa at position 6 is Ile, Thr, Leu, Met, Val or Ser; Xaa at position 7 is Ala, Met, Val, Leu, Ile or Gly; Xaa at position 8 is Thr, Asp, Ser or Glu; Xaa at position 9 is Glu, Leu, Gly, Asp, Ala, Ile, Val or Met; Xaa at position 10 is Glu, Asn, Asp or Gln; Xaa at position 11 is Ser, Val, Thr, Ile, Leu or Met; Xaa at position 12 is Lys, Glu, Arg or Asp; Xaa at position 13 is Ile, Val, Leu or Met; Xaa at position 14 is Arg, Gln, Lys or Asn; Xaa at position 16 is Tyr, Gln, Trp, Phe or Asn; Xaa at position 17 is Ala, Ser, Gly or Thr; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu, Ala, Ser, Asp or Gly; Xaa at position 24 is Ile, Leu, Val or Met; Xaa at position 26 is Val, Ser, Ile, Leu, Met or Thr; Xaa at position 27 is Val, Glu, Ile, Leu, Met or Asp; Xaa at position 29 is Ser, Met, Thr, Ile, Leu or Val; Xaa at position 30 is Asn, Asp, Ser, Glu, Gln or Thr; Xaa at position 31 is Phe, Ile, Leu, Val or Met; Xaa at position 32 is Lys, Glu, Arg or Asp; Xaa at position 33 is Val, Ile, Leu or Met; Xaa at position 34 is Glu, Lys, Asp or Arg; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Glu, Gln, Leu or Phe; Xaa at position 50 is Asp, Ser, Glu, Thr, Leu or Phe; Xaa at position 51 is Lys, Asn, Arg, Gln, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Thr, Leu or Phe; Xaa at position 56 is Ser, Asp, Thr, Glu or Leu; Xaa at position 57 is Gln, Thr, Glu, Asn, Ser, Asp, Leu or Phe; Xaa at position 58 is Ile, Val, Leu, Met or Phe; Xaa at position 60 is Gly, Lys, Ala or Arg; Xaa at position 61 is Thr, Ile or Phe; Xaa at position 62 is Ile, Lys, Val, Leu, Met, Arg or Phe; Xaa at position 64 is Lys, Ser, Glu, Arg, Thr, Asp, Leu or Phe; Xaa at position 65 is Asp, Ser, Glu, Thr, Leu or Phe; Xaa at position 66 is Glu, Gly, Asp or Ala; Xaa at position 67 is Asp, Thr, Glu or Ser; Xaa at position 68 is Ser, Lys, Thr or Arg; Xaa at position 69 is Tyr, Ser, Trp, Phe or Thr; Xaa at position 70 is Thr, Lys, Ser or Arg; Xaa at position 73 is Ser, Ala, Thr or Gly; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu, Ala, Asp or Gly; Xaa at position 78 is Asn, Asp, Gln or Glu; Xaa at position 79 is Ala, Thr, Gly or Ser; Xaa at position 82 is Gly, Glu, Asn, Trp or Tyr; Xaa at position 86 is Gly, Lys, Ala or Arg; Xaa at position 88 is Ser, Glu, Thr or Asp; Xaa at position 89 is Leu, Ile, Val or Met; Xaa at position 91 is Asp, His or Glu; Xaa at position 92 is Gly, Asp, Ala or Glu; Xaa at position 95 is Leu, Trp, Ile, Val, Met, Phe or Tyr; Xaa at position 96 is Val, Leu, Ile or Met; Xaa at position 97 is Phe, Ala or Gly; Xaa at position 98 is Glu, Thr, Asp or Ser; Xaa at position 100 is Tyr, Lys, Trp or Arg; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser, Ala, Thr or Gly; Xaa at position 111 is Asp, His, Asn, Glu or Gln; Xaa at position 112 is Glu, Ser, Asp or Thr; Xaa at position 113 is Leu, Ser, Ile, Val, Met or Thr; Xaa at position 114 is Thr or Ser; Xaa at position 115 is Val, Ile, Val or Met; Xaa at position 116 is Lys, Thr, Glu, Arg, Ser or Asp; Xaa at position 117 is Asp or Glu; Xaa at position 118 is Lys, Asp, Arg or Glu; Xaa at position 119 is Glu, Asn, Asp or Gln; Xaa at position 120 is Asn, Lys, Asp or Arg; Xaa at position 121 is Tyr, Leu or Phe; Xaa at position 122 is Thr, Lys, Ser, Arg, Leu or Phe; Xaa at position 123 is Val, Ile, Leu, Met, Phe or Asn; Xaa at position 124 is Ile, Ser, Asp, Leu, Val Met, Thr, Glu or Phe; Xaa at position 125 is Lys, Leu, Phe or Met; Xaa at position 126 is Lys, Glu, Arg, Asp, Leu or Phe; Xaa at position 128 is Gly, Leu or Phe; Xaa at position 129 is Gly, Asn, Ala, Gln, Leu or Phe; Xaa at position 130 is Ser, Ile, Thr, Leu, Val, Met or Phe; Xaa at position 131 is Pro, Ser or Thr; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val, Cys, Ile, Leu or Met; Xaa at position 143 is Val, Ile; Leu or Met; Xaa at position 145 is Lys, Val, Arg, Ile, Leu or Met; and Xaa at position 146 is Ser, Gly, Thr or Ala; and wherein, 1 to 14 amino acids are optionally deleted from the N-terminus of the polypeptide.

In some embodiments the nucleic acid molecules encode an AfIP-1A polypeptide having a nucleotide sequence encoding a polypeptide comprising one or more amino acid motifs selected from: i) amino acids 15-26 of SEQ ID NO: 2, amino acids 15-26 of SEQ ID NO: 255, amino acids 15-26 of SEQ ID NO: 256 or amino acids 15-26 of SEQ ID NO: 257, ii) amino acids 33-53 of SEQ ID NO: 2, amino acids 33-53 of SEQ ID NO: 255, amino acids 33-53 of SEQ ID NO: 256 or amino acids 33-53 of SEQ ID NO: 257, iii) amino acids 71-84 of SEQ ID NO: 2, amino acids 71-84 of SEQ ID NO: 255, amino acids 71-84 of SEQ ID NO: 256 or amino acids 71-84 of SEQ ID NO: 257 and iv) amino acids 100-107 of SEQ ID NO: 2, amino acids 100-107 of SEQ ID NO: 255, amino acids 100-107 of SEQ ID NO: 256 or amino acids 100-107 of SEQ ID NO: 257. In some embodiments the amino acid motif may optionally have a deletion of one or more amino acids within the motif, an insertion of one or more amino acids within the motif or combinations thereof. In some embodiments the nucleic acid molecules encode an AfIP-1A polypeptide having a nucleotide sequence encoding a polypeptide comprising an amino acid motif as represented by positions 100-107 of SEQ ID NO: 257 wherein at least one amino acid at positions 100-107 of SEQ ID NO: 257 are not identical to amino acids at positions 100-107 of SEQ ID NO: 18.

In some embodiments the nucleic acid molecules encode an AfIP-1A polypeptide having a nucleotide sequence encoding a polypeptide comprising an amino acid sequence having at least 80% identity to the amino acid sequence set forth in SEQ ID NO: 2

In some embodiments the nucleic acid molecules encode an AfIP-1A polypeptide having a nucleotide sequence encoding a polypeptide comprising an amino acid sequence having at least 80% identity to the amino acid sequence set forth in SEQ ID NO: 2, and wherein the polypeptide comprises one or more amino acid motifs selected from: i) amino acids 15-26 of SEQ ID NO: 2, amino acids 15-26 of SEQ ID NO: 255, amino acids 15-26 of SEQ ID NO: 256 or amino acids 15-26 of SEQ ID NO: 257, ii) amino acids 33-53 of SEQ ID NO: 2, amino acids 33-53 of SEQ ID NO: 255, amino acids 33-53 of SEQ ID NO: 256 or amino acids 33-53 of SEQ ID NO: 257, iii) amino acids 71-84 of SEQ ID NO: 2, amino acids 71-84 of SEQ ID NO: 255, amino acids 71-84 of SEQ ID NO: 256 or amino acids 71-84 of SEQ ID NO: 257 and iv) amino acids 100-107 of SEQ ID NO: 2, amino acids 100-107 of SEQ ID NO: 255, amino acids 100-107 of SEQ ID NO: 256 or amino acids 100-107 of SEQ ID NO: 257.

In some embodiments exemplary nucleic acid molecules encode an AfIP-1A polypeptide of SEQ ID NO: 2, SEQ ID NO: 6, SEQ ID NO: 28, SEQ ID NO: 32, SEQ ID NO: 36, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, and SEQ ID NO: 664, as well as amino acid substitutions including but not limited to the active variants of Table 14, Table 15, Table 16, Table 26, Table 30, Table 32, and/or Table 33, deletions, insertions and fragments thereof and combinations thereof.

In some embodiments the nucleic acid molecules encode an AfIP-1A polypeptide of Table 9, Table 10, Table 14, Table 15, Table 16, Table 26, Table 30, Table 32, and/or Table 33, combinations of the amino acid substitutions thereof, and deletions and/or insertions thereof.

In some embodiments the nucleic acid molecule encoding an AfIP-1B polypeptide is a polynucleotide having a nucleotide sequence encoding a polypeptide comprising an amino acid sequence having at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity, to the amino acid sequence of SEQ ID NO: 4, wherein the polypeptide has pesticidal activity.

In some embodiments the nucleic acid molecule encoding an AfIP-1B polypeptide is a polynucleotide having a nucleotide sequence encoding a polypeptide comprising an amino acid sequence of SEQ ID NO: 258 wherein Xaa at position 12 is Met or Leu; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly or Cys; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val, Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Gln, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val or Ala; Xaa at position 134 is Ser or Leu; Xaa at position 137 is Val, Phe, Ala, Leu, Trp, Pro, Ser, Cys Asp, Glu or Arg; Xaa at position 139 is Glu or Asp; Xaa at position 141 is Phe, Val, Leu, Ile, Trp, Ser or Cys; Xaa at position 144 is Ala or Val; Xaa at position 148 is Ser, Phe or Thr; Xaa at position 152 is Ile or Thr; Xaa at position 155 is Asp or Glu; Xaa at position 179 is Gly, Val, Trp, Ser, Cys or Arg; Xaa at position 181 is Ile, Val or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys or Phe; Xaa at position 202 is Lys or Asn; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile or Val; Xaa at position 296 is Lys or Glu; Xaa at position 298 is Ala or Glu; Xaa at position 299 is Glu or Gly; Xaa at position 300 is Ile or Val; Xaa at position 305 is Asp or Glu; Xaa at position 317 is Ala or Ser; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile or Val; Xaa at position 373 is Arg or Ser; Xaa at position 374 is Asn or Lys; Xaa at position 377 is Leu or Ile; Xaa at position 384 is Thr or Ala; Xaa at position 385 is Ile or Ser; Xaa at position 388 is Asp or Glu; Xaa at position 393 is Tyr or Phe; Xaa at position 398 is Ala or Val; Xaa at position 414 is Tyr or Phe; Xaa at position 418 is Ile or Leu; Xaa at position 419 is Ser or Asn; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr or Phe; Xaa at position 543 is Tyr or Phe; Xaa at position 544 is Lys or Arg; Xaa at position 547 is Tyr or Phe; Xaa at position 550 is Tyr or Phe; Xaa at position 552 is Asn or Ser; Xaa at position 558 is Phe or Leu; Xaa at position 600 is Met or Val; Xaa at position 602 is Met or Ile; Xaa at position 607 is Asp or Gly; Xaa at position 610 is Thr or Lys; Xaa at position 612 is Ile or Thr; Xaa at position 613 is Leu or Pro; Xaa at position 615 is Asn or Asp; Xaa at position 619 is Lys or Arg; Xaa at position 625 is Tyr or Phe; Xaa at position 631 is Ile, Val or Leu; Xaa at position 633 is Trp or Phe; Xaa at position 646 is Gln or Arg; Xaa at position 661 is Asn or Ser; Xaa at position 683 is Thr or Ala; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

In some embodiments the nucleic acid molecule encoding an AfIP-1B polypeptide is a polynucleotide having a nucleotide sequence encoding a polypeptide comprising an amino acid sequence of SEQ ID NO: 259, wherein Xaa at position 12 is Met, Leu, Ile or Val; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly, Cys or Ala; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Glu, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val, Ala, Ile or Leu; Xaa at position 134 is Ser or Leu; Xaa at position 137 is Val, Phe, Ala, Leu, Trp, Pro, Ser, Cys, Asp, Glu or Arg; Xaa at position 139 is Glu or Asp; Xaa at position 141 is Phe, Val, Leu, Ile, Trp, Ser or Cys; Xaa at position 144 is Ala, Val, Gly, Ile, Leu or Met; Xaa at position 148 is Ser, Phe, Thr or Trp; Xaa at position 152 is Ile, Thr, Leu, Val, Met or Ser; Xaa at position 155 is Asp or Glu; Xaa at position 179 is Gly, Val, Trp, Ser, Cys or Arg; Xaa at position 181 is Ile, Val, Met or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys, Tyr or Phe; Xaa at position 202 is Lys, Asn or Arg; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile, Val, Leu or Met; Xaa at position 296 is Lys or Glu; Xaa at position 298 is Ala, Glu, Gly or Asp; Xaa at position 299 is Glu, Gly, Asp or Ala; Xaa at position 300 is Ile, Val, Ile or Met; Xaa at position 305 is Asp or Glu; Xaa at position 317 is Ala, Ser, Gly or Thr; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile, Val, Leu or Met; Xaa at position 373 is Arg or Ser; Xaa at position 374 is Asn, Lys, Gln or Arg; Xaa at position 377 is Leu, Ile, Val or Met; Xaa at position 384 is Thr, Ala, Ser or Gly; Xaa at position 385 is Ile, Ser, Leu, Val, Met or Thr; Xaa at position 388 is Asp or Glu; Xaa at position 393 is Tyr, Phe or Trp; Xaa at position 398 is Ala or Val; Xaa at position 414 is Tyr or Phe; Xaa at position 418 is Ile or Leu; Xaa at position 419 is Ser, Asn, Thr or Gln; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr, Phe or Trp; Xaa at position 543 is Tyr or Phe; Xaa at position 544 is Lys or Arg; Xaa at position 547 is Tyr or Phe; Xaa at position 550 is Tyr, Phe or Trp; Xaa at position 552 is Asn, Ser, Gln or Thr; Xaa at position 558 is Phe or Leu; Xaa at position 600 is Met or Val; Xaa at position 602 is Met, Ile, Leu or Val; Xaa at position 607 is Asp or Gly; Xaa at position 610 is Thr, Lys, Ser or Arg; Xaa at position 612 is Ile or Thr; Xaa at position 613 is Leu or Pro; Xaa at position 615 is Asn or Asp; Xaa at position 619 is Lys or Arg; Xaa at position 625 is Tyr, Phe or Trp; Xaa at position 631 is Ile, Val, Leu or Met; Xaa at position 633 is Trp or Phe; Xaa at position 646 is Gln or Arg; Xaa at position 661 is Asn or Ser; Xaa at position 683 is Thr, Ala, Ser or Gly; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

In some embodiments the nucleic acid molecules encode an AfIP-1B polypeptide having a nucleotide sequence encoding a polypeptide comprising one or more amino acid motifs selected from i) amino acids 105-115 of SEQ ID NO: 4, amino acids 105-115 of SEQ ID NO: 258 or amino acids 105-115 of SEQ ID NO: 259, ii) amino acids 133-141 of SEQ ID NO: 4, amino acids 133-141 of SEQ ID NO: 258 or amino acids 133-141 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4, amino acids 358-365 of SEQ ID NO: 258 or amino acids 358-365 of SEQ ID NO: 259 and v) amino acids 511-520 of SEQ ID NO: 4, amino acids 511-520 of SEQ ID NO: 258 or amino acids 511-520 of SEQ ID NO: 259. In some embodiments the amino acid motif may optionally have a deletion of one or more amino acids within the motif, an insertion of one or more amino acids within the motif or combinations thereof.

In some embodiments the nucleic acid molecules encode an AfIP-1B polypeptide having a nucleotide sequence encoding a polypeptide comprising an amino acid sequence having at least 80% identity to the amino acid sequence set forth in SEQ ID NO: 4.

In some embodiments the nucleic acid molecules encode an AfIP-1B polypeptide having a nucleotide sequence encoding a polypeptide comprising an amino acid sequence having at least 80% identity to the amino acid sequence set forth in SEQ ID NO: 4 and wherein the polypeptide comprises one or more amino acid motifs selected from i) amino acids 105-115 of SEQ ID NO: 4, amino acids 105-115 of SEQ ID NO: 258 or amino acids 105-115 of SEQ ID NO: 259, ii) amino acids 133-141 of SEQ ID NO: 4, amino acids 133-141 of SEQ ID NO: 258 or amino acids 133-141 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4, amino acids 358-365 of SEQ ID NO: 258 or amino acids 358-365 of SEQ ID NO: 259, and v) amino acids 511-520 of SEQ ID NO: 4, amino acids 511-520 of SEQ ID NO: 258 or amino acids 511-520 of SEQ ID NO: 259.

In some embodiments exemplary nucleic acid molecules encode an AfIP-1B polypeptide of SEQ ID NO: 4, SEQ ID NO: 30, SEQ ID NO: 34, SEQ ID NO: 38, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:700, SEQ ID NO: 701, SEQ ID NO: 702, SEQ ID NO: 703, SEQ ID NO: 704, SEQ ID NO: 705, SEQ ID NO: 706, SEQ ID NO: 707 and SEQ ID NO: 708, as well as amino acid substitutions, deletions, insertions and fragments thereof.

In some embodiments the nucleic acid molecules encode an AfIP-1B polypeptide of Table 18, Table 20, Table 28, and/or 34, combinations of the amino acid substitutions thereof and deletions and/or insertions thereof.

Also provided are nucleic acid molecules that encode transcription and/or translation products that are subsequently spliced to ultimately produce functional AfIP-1A or AfIP-1B polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate an AfIP-1A and/or AfIP-1B polypeptide encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length AfIP-1A and/or AfIP-1B polypeptide, but rather encode a fragment or fragments of an AfIP-1A and/or AfIP-1B polypeptide. These polynucleotides can be used to express a functional AfIP-1A and/or AfIP-1B polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding AfIP-1A and/or AfIP-1B polypeptides are also encompassed by the embodiments. "Fragment" as used herein refers to a portion of the nucleic acid sequence encoding an AfIP-1A and/or AfIP-1B polypeptide. A fragment of a nucleic acid sequence may encode a biologically active portion of an AfIP-1A and/or AfIP-1B polypeptide or it may be a fragment that can be used as a hybridization probe or PCR primer using methods disclosed below. Nucleic acid molecules that are fragments of a nucleic acid sequence encoding an AfIP-1A polypeptide comprise at least about 150, 180, 210, 240, 270, 300, 330 or 360, contiguous nucleotides or up to the number of nucleotides present in a full-length nucleic acid sequence encoding an AfIP-1A polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the AfIP-1A polypeptide and, hence, retain insecticidal activity. "Retains AfIP-1A activity" is used herein to refer to a polypeptide having at least about 10%, at least about 30%, at least about 50%, at least about 70%, 80%, 90%, 95% or higher of the insecticidal activity of the full-length AfIP-1A polypeptide of SEQ ID NO: 2 alone or associated with the AfIP-1B polypeptide of SEQ ID NO: 4. In one embodiment, the insecticidal activity is Lepidoptera activity. Nucleic acid molecules that are fragments of a nucleic acid sequence encoding an AfIP-1B polypeptide comprise at least about 225, 450, 600, 750, 900, 1050, 1200, 1350, 1500, 1650, 1800, 1950 or 2100 contiguous nucleotides or up to the number of nucleotides present in a full-length nucleic acid sequence encoding an AfIP-1B polypeptide disclosed herein, depending upon the intended use. Fragments of the nucleic acid sequences of the embodiments will encode protein fragments that retain the biological activity of the AfIP-1B polypeptide and, hence, retain insecticidal activity. "Retains AfIP-1B activity" is used herein to refer to a polypeptide having at least about 10%, at least about 30%, at least about 50%, at least about 70%, 80%, 90%, 95% or higher of the insecticidal activity of the full-length AfIP-1B polypeptide of SEQ ID NO: 4 alone or associated with the AfIP-1A polypeptide of SEQ ID NO: 2. In one embodiment, the insecticidal activity is against a Lepidopteran species. In one embodiment, the insecticidal activity is against a Hem species.

In some embodiments a fragment of a nucleic acid sequence encoding an AfIP-1A polypeptide encoding a biologically active portion of a protein will encode at least about 15, 20, 30, 50, 75, 100, 125, contiguous amino acids or up to the total number of amino acids present in a full-length AfIP-1A polypeptide of the embodiments. In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 2, 28, 32 or 36 or variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, 25 or more amino acids from the N-terminus relative to SEQ ID NO: 2, 28, 32 or 36 or variants thereof, e.g., by proteolysis or by insertion of a start codon in the coding sequence. In some embodiments, the fragments encompassed herein result from the removal of the N-terminal 1, 2, 3, 4, 5, 6, 7, 8, 9, 10, 11, 12, 13, 14 amino acids relative to SEQ ID NOs: 2, 28, 32 or 36 or variants thereof, e.g., by proteolysis or by insertion of a start codon in the coding sequence.

In some embodiments a fragment of a nucleic acid sequence encoding an AfIP-1B polypeptide encoding a biologically active portion of a protein will encode at least about 75, 150, 200, 250, 300, 350, 400, 450, 500, 550, 600, 650 or 700, contiguous amino acids or up to the total number of amino acids present in a full-length AfIP-1B polypeptide of the embodiments. In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 4, 30, 34 or 38 or variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, 25 or more amino acids from the N-terminus relative to SEQ ID NOs: 4, 30, 34 or 38 or variants thereof, e.g., by proteolysis or by insertion of a start codon in the coding sequence. In some embodiments, the fragments encompassed herein result from the removal of 1, 2, 3, 4, 5, 6, 7, 8, 9, 10, 11, 12, 13, 14, 15, 16, 17, 18, 19, 20, 21, 22, 23, 24 or 25 amino acids from the C-terminus relative to SEQ ID NOs: 4, 30, 34 or 38 or variants thereof, e.g., by proteolysis or by deletion of the codons encoding the deleted amino acids with the concomitant insertion of a stop codon or by insertion of a stop codon in the coding sequence.

In some embodiments an AfIP-1A polypeptide is encoded by a nucleic acid sequence sufficiently homologous to the nucleic acid sequence of SEQ ID NO: 1, SEQ ID NO: 27, SEQ ID NO: 31 or SEQ ID NO: 35. “Sufficiently homologous” is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account codon degeneracy, amino acid similarity, reading frame positioning, and the like. In some embodiments the sequence homology is against the full length sequence of the polynucleotide encoding an AfIP-1A polypeptide or against the full length sequence of an AfIP-1A polypeptide. In some embodiments the AfIP-1A polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 28, SEQ ID NO: 32 or SEQ ID NO: 36. In some embodiments the sequence identity is against the full length sequence of the polynucleotide encoding an AfIP-1A polypeptide or against the full length sequence of an AfIP-1A polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

In some embodiments the AfIP-1B polypeptides are encoded by a nucleic acid sequence sufficiently homologous to the nucleic acid sequence of SEQ ID NO: 3, SEQ ID NO: 29, SEQ ID NO: 33 or SEQ ID NO: 37. “Sufficiently homologous” is used herein to refer to an amino acid or nucleic acid sequence that has at least about 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding identity of proteins encoded by two nucleic acid sequences by taking into account codon degeneracy, amino acid similarity, reading frame positioning, and the like. In some embodiments the sequence homology is against the full length sequence of the polynucleotide encoding an AfIP-1B polypeptide or against the full length sequence of an AfIP-1B polypeptide. In some embodiments the AfIP-1B polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 4, SEQ ID NO: 30, SEQ ID NO: 34 or SEQ ID NO: 38. In some embodiments the sequence identity is against the full length sequence of the polynucleotide encoding an AfIP-1B polypeptide or against the full length sequence of an AfIP-1B polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of one of SEQ ID NO: 1, SEQ ID NO: 2, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331: 27, SEQ ID NO: 31 or SEQ ID NO: 35, across the entirety of one of SEQ ID NO: 2, SEQ ID NO: 28, SEQ ID NO: 32 or SEQ ID NO: 36, across the entirety of one of SEQ ID NO: 3, SEQ ID NO: 29, SEQ ID NO: 33 or SEQ ID NO: 37, across the entirety of one of SEQ ID NO: 4, SEQ ID NO: 30, SEQ ID NO: 34 or SEQ ID NO: 38). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal nucleic acid molecules of the embodiments. BLAST protein searches can be performed with the BLASTX program, score=50, wordlength=3, to obtain amino acid sequences homologous to pesticidal protein molecules of the embodiments. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.* 22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™. GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) *CABIOS* 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. “Equivalent program” is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding variants of AfIP-1A and AfIP-1B polypeptide. “Variants” of the AfIP-1A and AfIP-1B polypeptide encoding nucleic acid sequences include those sequences that encode the AfIP-1A and AfIP-1B polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the AfIP-1A and AfIP-1B polypeptides disclosed as discussed below.

The skilled artisan will further appreciate that changes can be introduced by mutation of the nucleic acid sequences thereby leading to changes in the amino acid sequence of the encoded AfIP-1A and AfIP-1B polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present invention.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet.* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet.* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond* A 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol Volume* 154, which also describes useful controls for trouble-shooting problems with various mutagenesis methods.

Additional details regarding various diversity generating methods can be found in the following U.S. patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from other organisms, particularly other bacteria, particularly a *Alcaligenes* species and more particularly a *Alcaligenes faecalis* strain. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential AfIP-1A and AfIP-1B polypeptides from bacterial collections, the bacterial cell lysates can be screened with antibodies generated against an AfIP-1A or AfIP-1B polypeptide using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of AfIP-1A and AfIP-1B polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to AfIP-1A and AfIP-1B polypeptides) with sequence information of AfIP-1A and AfIP-1B (e.g., SEQ ID NO: 2, SEQ ID NO: 4)) and its homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known AfIP-1A or AfIP-1B polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding an AfIP-1A or AfIP-1B polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding an AfIP-1A or AfIP-1B polypeptide, disclosed herein or one or more portions thereof may be used as a probe capable of specifically hybridizing to corresponding nucleic acid sequences encoding AfIP-1A or AfIP-1B polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) *Anal. Biochem.* 138:267-284: Tm=81.5° C.+16.6 (log M)+0.41 (% GC)-0.61 (% form)-500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with ≥90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology-Hybridization with Nucleic Acid Probes, Part I, Chapter 2 (Elsevier, N.Y.); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

Proteins and Variants and Fragments Thereof

AfIP-1A and AfIP-1B polypeptides are also encompassed by the disclosure. "*Alcaligenes* Insecticidal Protein-1A", "AfIP-1A polypeptide" or "AfIP-1A protein" as used herein interchangeably refers to a polypeptide having pesticidal activity including but not limited to fungicidal activity, and insecticidal activity, either alone or associated with an AfIP-1B polypeptide, against one or more insect pests of the Lepidoptera and/or Coleoptera orders, and is sufficiently homologous to the protein of SEQ ID NO: 2. A variety of AfIP-1A polypeptides are contemplated. One source of polynucleotides that encode an AfIP-1A polypeptide or related proteins is an *Alcaligenes faecalis* strain which comprises the polynucleotide of SEQ ID NO: 1, SEQ ID NO: 27, SEQ ID NO: 31 or SEQ ID NO: 35 encoding the AfIP-1A polypeptide of SEQ ID NO: 2, SEQ ID NO: 28, SEQ ID NO: 32 or SEQ ID NO: 36 respectively. "*Alcaligenes* Insecticidal Protein-1B", "AfIP-1B polypeptide" or "AfIP-1B protein" as used herein interchangeably refers to a polypeptide having pesticidal activity including but not limited to fungicidal activity and insecticidal activity, either alone or associated with an AfIP-1A polypeptide, against one or more insect pests of the Lepidoptera and/or Coleoptera orders, and is sufficiently homologous to the protein of SEQ ID NO: 4. A variety of AfIP-1B polypeptides are contemplated. One source of polynucleotides that encode an AfIP-1B polypeptide or related proteins is an *Alcaligenes faecalis* strain which comprises the polynucleotide of SEQ ID NO: 3, SEQ ID NO: 29, SEQ ID NO: 33 or SEQ ID NO: 37 encoding the AfIP-1B polypeptide of SEQ ID NO: 4, SEQ ID NO: 30, SEQ ID NO: 34 or SEQ ID NO: 38, respectively.

In some embodiments an AfIP-1A polypeptide is sufficiently homologous to the amino acid sequence of SEQ ID NO: 2, SEQ ID NO: 28, SEQ ID NO: 32 or SEQ ID NO: 36. "Sufficiently homologous" is used herein to refer to an amino acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins taking into account amino acid similarity and the like. In some embodiments the sequence homology is against the full length sequence an AfIP-1A polypeptide. In some embodiments the AfIP-1A polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 28, SEQ ID NO: 32 or SEQ ID NO: 36. In some embodiments the sequence identity is against the full length sequence of an AfIP-1A polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1B polypeptide is sufficiently homologous to the amino acid sequence of SEQ ID NO: 4, SEQ ID NO: 30, SEQ ID NO: 34 or SEQ ID NO: 38. "Sufficiently homologous" is used herein to refer to an amino acid sequence that has at least about 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding identity of proteins by taking into account amino acid similarity and the like. In some embodiments the AfIP-1B polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 4, SEQ ID NO: 30, SEQ ID NO: 34 or SEQ ID NO: 38. In some embodiments the sequence identity is against the full length sequence of an AfIP-1B polypeptide. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. An AfIP-1A or AfIP-1B polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to an AfIP-1A or AfIP-1B polypeptide and that exhibit insecticidal activity. "Fragments" or "biologically active portions" of AfIP-1A polypeptides includes fragments comprising amino acid sequences sufficiently identical to the amino acid sequence set forth in SEQ ID NO: 2, SEQ ID NO: 28, SEQ ID NO: 32 or SEQ ID NO: 36 respectively including but not limited to SEQ ID NO: 6 and SEQ ID NO: 152 and that exhibit insecticidal activity. A biologically active portion of an AfIP-1A polypeptide can be a polypeptide that is, for example, 10, 25, 50, 75, 100, 125, 132 or more amino acids in length. Such biologically active portions can be prepared by recombinant techniques and evaluated for insecticidal activity. As used here, a fragment comprises at least 8 contiguous amino acids of an AfIP-1A polypeptide. In some embodiments an AfIP-1A polypeptide fragment comprises at least 8 contiguous amino acids of SEQ ID NO: 2, SEQ ID NO: 28, SEQ ID NO: 32 or SEQ ID NO: 36. In some embodiments a fragment comprises at least 8 contiguous amino acids of SEQ ID NO: 2. In some embodiments a fragment comprises at least 8 contiguous amino acids of SEQ ID NO: 18. "Fragments" or "biologically active portions" of AfIP-1B polypeptide include fragments comprising amino acid sequences sufficiently identical to the amino acid sequence set forth in SEQ ID NO: 4, SEQ ID NO: 30, SEQ ID NO: 34 or SEQ ID NO: 38 respectively including but not limited to amino acids 1 to 380 of SEQ ID NO: 4 and amino acids 381 to 703 of SEQ ID NO: 4, and that exhibit insecticidal activity. A biologically active portion of an AfIP-1B polypeptide can be a polypeptide that is, for example, 10, 25, 50, 75, 100, 150, 200, 250, 300, 350, 400, 450, 500, 550, 600, 650 or more amino acids in length. Such biologically active portions can be prepared by recombinant techniques and evaluated for insecticidal activity. As used here, a fragment comprises at least 8 contiguous amino acids of an AfIP-1B polypeptide. In some embodiments a fragment comprises at least 8 contiguous amino acids of SEQ ID NO: 4, SEQ ID NO: 30, SEQ ID NO: 34 or SEQ ID NO: 38. In some embodiments a fragment comprises at least 8 contiguous amino acids of SEQ ID NO: 4. In some embodiments a fragment comprises at least 8 contiguous amino acids of SEQ ID NO: 20.

In some embodiments, the AfIP-1A polypeptide fragment is an N-terminal and/or a C-terminal truncation of at least about 1, 2, 3, 4, 5, 6, 7, 8, 9, 10, 11, 12, 13, 14, 15, 16, 17, 18, 19, 20, 25, 26, 27, 28, 29, 30, 31, 32, 33, 34 or more amino acids from the N-terminus and/or C-terminus relative to SEQ ID NO: 2, SEQ ID NO: 28, SEQ ID NO: 32 or SEQ ID NO: 36 or variants thereof including but not limited to SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, and SEQ ID NO: 664, e.g., by proteolysis, by insertion of a start codon, by deletion of the codons encoding the deleted amino acids and concomitant insertion of a start codon, and/or insertion of a stop codon. In some embodiments, the AfIP-1A polypeptide fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, or more amino acids relative to SEQ ID NO: 2, SEQ ID NO: 28, SEQ ID NO: 32 or SEQ ID NO: 36 and variants thereof including, but not limited to, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, and SEQ ID NO: 664, e.g., by proteolysis or by insertion of a start codon, by deletion of the codons encoding the deleted amino acids and concomitant insertion of a start codon.

In some embodiments, the AfIP-1A polypeptide fragments encompassed herein result from the removal of the N-terminal 1, 2, 3, 4, 5, 6, 7, 8, 9, 10, 11, 12, 13, 14, amino acids relative to SEQ ID NO: 2, SEQ ID NO: 28, SEQ ID NO: 32 or SEQ ID NO: 36 and variants thereof including, but not limited to, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, and SEQ ID NO: 664. In some embodiments the truncation is of the first 4 amino acids of SEQ ID NO: 2 resulting in an AfIP-1A polypeptide from amino acids 5-146 of SEQ ID NO: 2. In some embodiments the truncation is of the first 14 amino acids of SEQ ID NO: 2 resulting in an AfIP-1A polypeptide from amino acids 15-146 of SEQ ID NO: 2. In some embodiments the truncated AfIP-1A polypeptide is the polypeptide of SEQ ID NO: 6 or SEQ ID NO: 152.

In some embodiments, the AfIP-1B polypeptide fragment is an N-terminal and/or a C-terminal truncation of at least about 1, 2, 3, 4, 5, 6, 7, 8, 9, 10, 11, 12, 13, 14, 15, 16, 17, 18, 19, 20, 25 or more amino acids from the N-terminus and/or C-terminus relative to SEQ ID NO: 4, SEQ ID NO: 30, SEQ ID NO: 34 or SEQ ID NO: 38 or variants thereof including but not limited to SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:700, SEQ ID NO: 701, SEQ ID NO: 702, SEQ ID NO: 703, SEQ ID NO: 704, SEQ ID NO: 705, SEQ ID NO: 706, SEQ ID NO: 707 and SEQ ID NO: 708, e.g., by proteolysis, by insertion of a start codon, by deletion of the codons encoding the deleted amino acids and concomitant insertion of a start codon and/or insertion of a stop codon.

In some embodiments, the AfIP-1B polypeptide fragments encompassed herein result from the removal of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the C-terminus relative to SEQ ID NO: 4, SEQ ID NO: 30, SEQ ID NO: 34 or SEQ ID NO: 38 and variants thereof including but not limited to SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:700, SEQ ID NO: 701, SEQ ID NO: 702, SEQ ID NO: 703, SEQ ID NO: 704, SEQ ID NO: 705, SEQ ID NO: 706, SEQ ID NO: 707 and SEQ ID NO: 708, e.g., by proteolysis or by insertion of a start codon, by deletion of the codons encoding the deleted amino acids and concomitant insertion of a start codon.

In some embodiments, the AfIP-1B polypeptide fragments encompassed herein result from the removal of 1, 2, 3, 4, 5, 6, 7, 8, 9, 10, 11, 12, 13, 14, 15, 16, 17, 18, 19, 20, 21, 22, 23, 24 or 25 amino acids from the C-terminus relative to SEQ ID NO: 4, SEQ ID NO: 30, SEQ ID NO: 34 or SEQ ID NO: 38 and variants thereof including, but not limited to, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:700, SEQ ID NO: 701, SEQ ID NO: 702, SEQ ID NO: 703, SEQ ID NO: 704, SEQ ID NO: 705, SEQ ID NO: 706, SEQ ID NO: 707 and SEQ ID NO: 708.

In some embodiments the AfIP-1B polypeptide fragment is amino acids 1 to 380 of SEQ ID NO: 4. In some embodiments the AfIP-1B polypeptide fragment is amino acids 381 to 703 of SEQ ID NO: 4. It is well known in the art that polynucleotide encoding the truncated polypeptide can be engineered to add a start codon at the N-terminus such as ATG encoding methionine or methionine followed by an alanine. It is also well known in the art that depending on what host the polypeptide is expressed in the methionine may be partially of completed processed off.

In some embodiments, fragments, biologically active portions of SEQ ID NO: 18 and/or SEQ ID NO: 20 as well as amino acid substitutions, deletions and/or insertions thereof are also provided, and may be used to practice the methods of the disclosure.

“Variants” as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence.

In some embodiments an AfIP-1A polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 2, SEQ ID NO: 28, SEQ ID NO: 32 or SEQ ID NO: 36. In some embodiments an AfIP-1A polypeptide has at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 2, SEQ ID NO: 28, SEQ ID NO: 32 or SEQ ID NO: 36. In some embodiments an AfIP-1A polypeptide has at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 2. In some embodiments an AfIP-1A polypeptide comprises an amino acid sequence having at least 50% identity, to the amino acid sequence of SEQ ID NO: 2, SEQ ID NO: 28, SEQ ID NO: 32 or SEQ ID NO: 36, wherein the polypeptide has insecticidal activity and/or pesticidal activity. In some embodiments an AfIP-1A polypeptide comprises an amino acid sequence having at least 80% identity, to the amino acid sequence of SEQ ID NO: 2, SEQ ID NO: 28, SEQ ID NO: 32 or SEQ ID NO: 36, wherein the polypeptide has insecticidal activity and/or pesticidal activity. In some embodiments an AfIP-1A polypeptide comprises an amino acid sequence having at least 80% identity to the amino acid sequence of SEQ ID NO: 2, wherein the polypeptide has insecticidal activity and/or pesticidal activity. In some embodiments an AfIP-1A polypeptide comprises an amino acid sequence having at least 85% identity to the amino acid sequence of SEQ ID NO: 2, wherein the polypeptide has insecticidal activity and/or pesticidal activity. In some embodiments an insecticidal polypeptide has at least about 50%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 18.

In some embodiments an AfIP-1A polypeptide comprises one or more amino acid motifs selected from: i) amino acids 15-26 of SEQ ID NO: 2, amino acids 15-26 of SEQ ID NO: 255, amino acids 15-26 of SEQ ID NO: 256 or amino acids 15-26 of SEQ ID NO: 257, ii) amino acids 33-53 of SEQ ID NO: 2, amino acids 33-53 of SEQ ID NO: 255, amino acids 33-53 of SEQ ID NO: 256 or amino acids 33-53 of SEQ ID NO: 257, iii) amino acids 71-84 of SEQ ID NO: 2, amino acids 71-84 of SEQ ID NO: 255, amino acids 71-84 of SEQ ID NO: 256 or amino acids 71-84 of SEQ ID NO: 257 and iv) amino acids 100-107 of SEQ ID NO: 2, amino acids 100-107 of SEQ ID NO: 255, amino acids 100-107 of SEQ ID NO: 256 or amino acids 100-107 of SEQ ID NO: 257. In some embodiments the amino acid motif may optionally have a deletion of one or more amino acids within the motif, an insertion of one or more amino acids within the motif or combinations thereof. In some embodiments the AfIP-1A polypeptide comprises an amino acid motif as represented by positions 100-107 of SEQ ID NO: 257 wherein at least one amino acid at positions 100-107 of SEQ ID NO: 257 are not identical to amino acids at positions 100-107 of SEQ ID NO: 18.

In some embodiments an AfIP-1A polypeptide comprises an amino acid sequence having at least 50% identity to the amino acid sequence set forth in SEQ ID NO: 2, SEQ ID NO: 28, SEQ ID NO: 32 or SEQ ID NO: 36. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1A polypeptide comprises an amino acid sequence having at least 80% identity to the amino acid sequence set forth in SEQ ID NO: 2, SEQ ID NO: 28, SEQ ID NO: 32 or SEQ ID NO: 36. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1A polypeptide comprises an amino acid sequence having at least 90% identity to the amino acid sequence set forth in SEQ ID NO: 2, SEQ ID NO: 28, SEQ ID NO: 32 or SEQ ID NO: 36. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1A polypeptide comprises an amino acid sequence having at least 95% identity to the amino acid sequence set forth in SEQ ID NO: 2, SEQ ID NO: 28, SEQ ID NO: 32 or SEQ ID NO: 36. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1A polypeptide comprises an amino acid sequence having at least 50% identity to the amino acid sequence set forth in SEQ ID NO: 2, SEQ ID NO: 28, SEQ ID NO: 32 or SEQ ID NO: 36 and comprises one or more amino acid motifs selected from: i) amino acids 15-26 of SEQ ID NO: 2, amino acids 15-26 of SEQ ID NO: 255, amino acids 15-26 of SEQ ID NO: 256 or amino acids 15-26 of SEQ ID NO: 257, ii) amino acids 33-53 of SEQ ID NO: 2, amino acids 33-53 of SEQ ID NO: 255, amino acids 33-53 of SEQ ID NO: 256 or amino acids 33-53 of SEQ ID NO: 257, iii) amino acids 71-84 of SEQ ID NO: 2, amino acids 71-84 of SEQ ID NO: 255, amino acids 71-84 of SEQ ID NO: 256 or amino acids 71-84 of SEQ ID NO: 257 and iv) amino acids 100-107 of SEQ ID NO: 2, amino acids 100-107 of SEQ ID NO: 255, amino acids 100-107 of SEQ ID NO: 256 or amino acids 100-107 of SEQ ID NO: 257.

In some embodiments the AfIP-1A polypeptide comprises an amino acid motif as represented by positions 100-107 of SEQ ID NO: 256, wherein at least one amino acid at positions 100-107 of SEQ ID NO: 256 are not identical to amino acids at positions 101-107 of SEQ ID NO: 18.

In some embodiments an AfIP-1A polypeptide comprises an amino acid sequence having at least 80% identity to the amino acid sequence set forth in SEQ ID NO: 2, SEQ ID NO: 28, SEQ ID NO: 32 or SEQ ID NO: 36 and comprises one or more amino acid motifs selected from: i) amino acids 15-26 of SEQ ID NO: 2, amino acids 15-26 of SEQ ID NO: 255, amino acids 15-26 of SEQ ID NO: 256 or amino acids 15-26 of SEQ ID NO: 257, ii) amino acids 33-53 of SEQ ID NO: 2, amino acids 33-53 of SEQ ID NO: 255, amino acids 33-53 of SEQ ID NO: 256 or amino acids 33-53 of SEQ ID NO: 257, iii) amino acids 71-84 of SEQ ID NO: 2, amino acids 71-84 of SEQ ID NO: 255, amino acids 71-84 of SEQ ID NO: 256 or amino acids 71-84 of SEQ ID NO: 257 and iv) amino acids 100-107 of SEQ ID NO: 2, amino acids 100-107 of SEQ ID NO: 255, amino acids 100-107 of SEQ ID NO: 256 or amino acids 100-107 of SEQ ID NO: 257.

In some embodiments the AfIP-1A polypeptide comprises an amino acid motif as represented by positions 100-107 of SEQ ID NO: 257 wherein at least one amino acid at positions 100-107 of SEQ ID NO: 257 are not identical to amino acids at positions 100-107 of SEQ ID NO: 18.

In some embodiments an AfIP-1A polypeptide comprises an amino acid sequence of SEQ ID NO: 255, wherein Xaa at position 6 is Ile or Thr; Xaa at position 7 is Ala or Val; Xaa at position 9 is Glu or Gly; Xaa at position 13 is Ile or Val; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr or Ala; Xaa at position 24 is Ile or Leu; Xaa at position 30 is Asn or Ser; Xaa at position 33 is Val or Ile; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Leu or Phe; Xaa at position 51 is Lys, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Leu or Phe; Xaa at position 56 is Ser or Leu; Xaa at position 57 is Gln, Glu, Leu or Phe; Xaa at position 58 is Ile, Val, Leu or Phe; Xaa at position 60 is Gly, Leu of Phe; Xaa at position 61 is Thr, Ile or Phe; Xaa at position 62 is Ile, Val, Leu or Phe; Xaa at position 64 is Lys, Glu, Leu or Phe; Xaa at position 65 is Asp, Leu or Phe; Xaa at position 67 is Asp or Glu; Xaa at position 68 is Ser or Thr; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 82 is Gly, Glu, Asn, Trp or Tyr; Xaa at position 96 is Val or Ile; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 111 is Asp or Asn; Xaa at position 113 is Leu or Ser; Xaa at position 115 is Val or Ile; Xaa at position 116 is Lys or Glu; Xaa at position 120 is Asn or Lys; Xaa at position 121 is Tyr, Leu or Phe; Xaa at position 122 is Thr, Leu or Phe; Xaa at position 123 is Val, Leu, Phe or Asn; Xaa at position 124 is Ile, Ser, Leu or Phe; Xaa at position 125 is Lys, Leu, Phe or Met; Xaa at position 126 is Lys, Leu or Phe; Xaa at position 128 is Gly, Leu or Phe; Xaa at position 129 is Gly, Leu or Phe; Xaa at position 130 is Ser, Leu or Phe; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; and Xaa at position 140 is Ile, Ala, Cys, Phe, His, Leu, Met, Asn, Gln, Thr, Val or Tyr; and wherein, 1 to 14 amino acids are optionally deleted from the N-terminus of the polypeptide.

In some embodiments an AfIP-1A polypeptide comprises an amino acid sequence of SEQ ID NO: 255 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 amino acid substitutions, in any combination, at residues designated by Xaa in SEQ ID NO: 255 compared to the native amino acid at the corresponding position of SEQ ID NO: 2.

In some embodiments an AfIP-1A polypeptide comprises an amino acid sequence of SEQ ID NO: 255 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 255 compared to the native amino acid at the corresponding position of SEQ ID NO: 2.

In some embodiments an AfIP-1A polypeptide comprises an amino acid sequence of SEQ ID NO: 256, wherein Xaa at position 6 is Ile or Thr; Xaa at position 7 is Ala, Met or Val; Xaa at position 8 is Thr or Asp; Xaa at position 9 is Glu, Leu or Gly; Xaa at position 10 is Glu or Asn; Xaa at position 11 is Ser or Val; Xaa at position 12 is Lys or Glu; Xaa at position 13 is Ile or Val; Xaa at position 14 is Arg or Gln; Xaa at position 16 is Tyr or Gln; Xaa at position 17 is Ala or Ser; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu or Ala; Xaa at position 24 is Ile or Leu; Xaa at position 26 is Val or Ser; Xaa at position 27 is Val or Glu; Xaa at position 29 is Ser or Met; Xaa at position 30 is Asn, Asp or Ser; Xaa at position 31 is Phe or Ile; Xaa at position 32 is Lys or Glu; Xaa at position 33 is Val or Ile; Xaa at position 34 is Glu or Lys; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Leu or Phe; Xaa at position 49 is Lys, Leu or Phe; Xaa at position 50 is Asp, Ser, Leu or Phe; Xaa at position 51 is Lys, Asn, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Leu or Phe; Xaa at position 56 is Ser, Asp or Leu; Xaa at position 57 is Gln, Thr, Glu, Leu or Phe; Xaa at position 58 is Ile, Val, Leu or Phe; Xaa at position 60 is Gly, Lys, Leu or Phe; Xaa at position 61 is Thr, Ile or Phe; Xaa at position 62 is Ile, Lys, Val, Leu or Phe; Xaa at position 64 is Lys, Ser, Glu, Leu or Phe; Xaa at position 65 is Asp, Ser, Leu or Phe; Xaa at position 66 is Glu or Gly; Xaa at position 67 is Asp, Thr or Glu; Xaa at position 68 is Ser, Lys or Thr; Xaa at position 69 is Tyr or Ser; Xaa at position 70 is Thr or Lys; Xaa at position 73 is Ser or Ala; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu or Ala; Xaa at position 78 is Asn or Asp; Xaa at position 79 is Ala or Thr; Xaa at position 82 is Gly, Glu, Asn, Trp or Tyr; Xaa at position 86 is Gly or Lys; Xaa at position 88 is Ser or Glu; Xaa at position 89 is Leu or Ile; Xaa at position 91 is Asp or His; Xaa at position 92 is Gly or Asp; Xaa at position 95 is Leu or Trp; Xaa at position 96 is Val, Leu or Ile; Xaa at position 97 is Phe or Ala; Xaa at position 98 is Glu or Thr; Xaa at position 100 is Tyr or Lys; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser or Ala; Xaa at position 111 is Asp, His or Asn; Xaa at position 112 is Glu or Ser; Xaa at position 113 is Leu or Ser; Xaa at position 114 is Thr or Ser; Xaa at position 115 is Val or Ile; Xaa at position 116 is Lys, Thr or Glu; Xaa at position 117 is Asp or Glu; Xaa at position 118 is Lys or Asp; Xaa at position 119 is Glu or Asn; Xaa at position 120 is Asn or Lys; Xaa at position 121 is Tyr, Leu or Phe; Xaa at position 122 is Thr, Lys, Leu or Phe; Xaa at position 123 is Val, Ile, Leu, Phe or Asn; Xaa at position 124 is Ile, Ser, Asp, Leu or Phe; Xaa at position 125 is Lys, Leu, Phe or Met; Xaa at position 126 is Lys, Glu, Leu or Phe; Xaa at position 128 is Gly, Leu or Phe; Xaa at position 129 is Gly, Asn, Leu or Phe; Xaa at position 130 is Ser, Ile, Leu or Phe; Xaa at position 131 is Pro or Ser; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val or Cys; Xaa at position 143 is Val or Ile; Xaa at position 145 is Lys or Val; and Xaa at position 146 is Ser or Gly; and wherein, 1 to 14 amino acids are optionally deleted from the N-terminus of the polypeptide.

In some embodiments an AfIP-1A polypeptide comprises an amino acid sequence of SEQ ID NO: 256 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 amino acid substitutions, in any combination, at residues designated by Xaa in SEQ ID NO: 256 compared to the native amino acid at the corresponding position of SEQ ID NO: 2.

In some embodiments an AfIP-1A polypeptide comprises an amino acid sequence of SEQ ID NO: 256 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 256 compared to the native amino acid at the corresponding position of SEQ ID NO: 2.

In some embodiments an AfIP-1A polypeptide comprises an amino acid sequence of SEQ ID NO: 257 wherein Xaa at position 6 is Ile, Thr, Leu, Met, Val or Ser; Xaa at position 7 is Ala, Met, Val, Leu, Ile or Gly; Xaa at position 8 is Thr, Asp, Ser or Glu; Xaa at position 9 is Glu, Leu, Gly, Asp, Ala, Ile, Val or Met; Xaa at position 10 is Glu, Asn, Asp or Gln; Xaa at position 11 is Ser, Val, Thr, Ile, Leu or Met; Xaa at position 12 is Lys, Glu, Arg or Asp; Xaa at position 13 is Ile, Val, Leu or Met; Xaa at position 14 is Arg, Gln, Lys or Asn; Xaa at position 16 is Tyr, Gln, Trp, Phe or Asn; Xaa at position 17 is Ala, Ser, Gly or Thr; Xaa at position 19 is Trp, Glu, Phe, Ile, His, Asn or Tyr; Xaa at position 20 is Ile, Val, Ala, Cys, Glu, Phe, Gly, Met, Asn, Gln, Arg, Ser or Thr; Xaa at position 23 is Thr, Glu, Ala, Ser, Asp or Gly; Xaa at position 24 is Ile, Leu, Val or Met; Xaa at position 26 is Val, Ser, Ile, Leu, Met or Thr; Xaa at position 27 is Val, Glu, Ile, Leu, Met or Asp; Xaa at position 29 is Ser, Met, Thr, Ile, Leu or Val; Xaa at position 30 is Asn, Asp, Ser, Glu, Gln or Thr; Xaa at position 31 is Phe, Ile, Leu, Val or Met; Xaa at position 32 is Lys, Glu, Arg or Asp; Xaa at position 33 is Val, Ile, Leu or Met; Xaa at position 34 is Glu, Lys, Asp or Arg; Xaa at position 35 is Gly or Asn; Xaa at position 36 is Ala, Gly, Asp, Glu, Phe, Gly, Ile, Leu, Pro, Gln, Arg, Ser, Thr, Val, Trp or Tyr; Xaa at position 37 is Tyr, Ala, Cys, Asp, Glu, Gly, His, Ile, Lys, Leu, Met, Pro, Arg, Ser, Thr, Val or Trp; Xaa at position 38 is Leu, Ala, Cys, Asp, Glu, Phe, Gly, His, Ile, Lys, Met, Gln, Arg, Ser, Thr, Val, Trp or Tyr; Xaa at position 39 is Arg, Lys, Cys, Asp, Glu, Phe, Gly, Ile, Lys, Leu, Met, Asn, Pro, Ser, Thr, Val, Trp or Tyr; Xaa at position 40 is Trp, Ala, Cys, Asp, Glu, Phe, Gly, His, Ile, Lys, Leu, Met, Asn, Pro, Gln, Arg, Ser, Thr, Val or Tyr; Xaa at position 41 is Gly, Cys or Gln; Xaa at position 42 is Lys, Cys, Glu, His, Leu, Met, Asn, Gln, Arg or Thr; Xaa at position 43 is Phe, Tyr, Ala, Cys, Glu, Ile, Leu, Met, Gln, Ser, Val or Trp; Xaa at position 44 is His, Ala, Asp, Glu, Gly, Lys, Leu, Met, Asn, Pro, Glu, Arg, Ser, Thr, Val, Trp; Xaa at position 45 is Val, Ala, Cys, Asp, Glu, Phe, Gly, His, Ile, Lys, Leu, Asn, Pro, Gln, Arg, Ser, Thr or Trp; Xaa at position 46 is Pro, Ala, Cys, Asp, Glu, Gly, His, Lys, Leu, Met, Gln, Arg, Ser, Thr, Val, Trp or Tyr; Xaa at position 47 is Gly, Leu or Phe; Xaa at position 48 is Asp, Asn, Glu, Gln, Leu or Phe; Xaa at position 50 is Asp, Ser, Glu, Thr, Leu or Phe; Xaa at position 51 is Lys, Asn, Arg, Gln, Leu or Phe; Xaa at position 52 is Glu, Leu or Phe; Xaa at position 53 is Ile, Leu or Phe; Xaa at position 54 is Ser, Thr, Leu or Phe; Xaa at position 55 is Pro, Ser, Thr, Leu or Phe; Xaa at position 56 is Ser, Asp, Thr, Glu or Leu; Xaa at position 57 is Gln, Thr, Glu, Asn, Ser, Asp, Leu or Phe; Xaa at position 58 is Ile, Val, Leu, Met or Phe; Xaa at position 60 is Gly, Lys, Ala or Arg; Xaa at position 61 is Thr, Ile or Phe; Xaa at position 62 is Ile, Lys, Val, Leu, Met, Arg or Phe; Xaa at position 64 is Lys, Ser, Glu, Arg, Thr, Asp, Leu or Phe; Xaa at position 65 is Asp, Ser, Glu, Thr, Leu or Phe; Xaa at position 66 is Glu, Gly, Asp or Ala; Xaa at position 67 is Asp, Thr, Glu or Ser; Xaa at position 68 is Ser, Lys, Thr or Arg; Xaa at position 69 is Tyr, Ser, Trp, Phe or Thr; Xaa at position 70 is Thr, Lys, Ser or Arg; Xaa at position 73 is Ser, Ala, Thr or Gly; Xaa at position 74 is Cys, Ala, Asp, Glu, Gly, His, Ile, Lys, Leu, Asn, Pro, Gln, Arg, Ser, Thr or Tyr; Xaa at position 76 is Arg, Cys, Asp, Glu, Phe, Gly, His, Ile, Lys, Leu, Met, Asn, Pro, Gln, Ser, Thr, Val, Trp or Tyr; Xaa at position 77 is Glu, Ala, Asp or Gly; Xaa at position 78 is Asn, Asp, Gln or Glu; Xaa at position 79 is Ala, Thr, Gly or Ser; Xaa at position 82 is Gly, Glu, Asn, Trp or Tyr; Xaa at position 86 is Gly, Lys, Ala or Arg; Xaa at position 88 is Ser, Glu, Thr or Asp; Xaa at position 89 is Leu, Ile, Val or Met; Xaa at position 91 is Asp, His or Glu; Xaa at position 92 is Gly, Asp, Ala or Glu; Xaa at position 95 is Leu, Trp, Ile, Val, Met, Phe or Tyr; Xaa at position 96 is Val, Leu, Ile or Met; Xaa at position 97 is Phe, Ala or Gly; Xaa at position 98 is Glu, Thr, Asp or Ser; Xaa at position 100 is Tyr, Lys, Trp or Arg; Xaa at position 101 is Trp, Phe or Tyr; Xaa at position 104 is Pro, Ala, Phe, Gly, His, Met, Gln, Arg or Val; Xaa at position 105 is Trp, Asp, Phe, Ile, Leu or Tyr; Xaa at position 106 is Ser, Ala, Thr or Gly; Xaa at position 111 is Asp, His, Asn, Glu or Gln; Xaa at position 112 is Glu, Ser, Asp or Thr; Xaa at position 113 is Leu, Ser, Ile, Val, Met or Thr; Xaa at position 114 is Thr or Ser; Xaa at position 115 is Val, Ile, Val or Met; Xaa at position 116 is Lys, Thr, Glu, Arg, Ser or Asp; Xaa at position 117 is Asp or Glu; Xaa at position 118 is Lys, Asp, Arg or Glu; Xaa at position 119 is Glu, Asn, Asp or Gln; Xaa at position 120 is Asn, Lys, Asp or Arg; Xaa at position 121 is Tyr, Leu or Phe; Xaa at position 122 is Thr, Lys, Ser, Arg, Leu or Phe; Xaa at position 123 is Val, Ile, Leu, Met, Phe or Asn; Xaa at position 124 is Ile, Ser, Asp, Leu, Val Met, Thr, Glu or Phe; Xaa at position 125 is Lys, Leu, Phe or Met; Xaa at position 126 is Lys, Glu, Arg, Asp, Leu or Phe; Xaa at position 128 is Gly, Leu or Phe; Xaa at position 129 is Gly, Asn, Ala, Gln, Leu or Phe; Xaa at position 130 is Ser, Ile, Thr, Leu, Val, Met or Phe; Xaa at position 131 is Pro, Ser or Thr; Xaa at position 132 is Ser, Ala, Cys, Asp, Glu, Phe, Gly, His, Ile, Lys, Leu, Met, Asn, Pro, Gln, Arg, Thr, Val, Trp or Tyr; Xaa at position 133 is Gly, Ala, Cys, Asp, Glu, Phe, His, Ile, Lys, Leu, Met, Asn, Pro, Gln, Arg, Ser, Thr, Val or Trp; Xaa at position 134 is Ala, Cys, Asp, Glu, Phe, Gly, His, Ile, Lys, Leu, Met, Asn, Pro, Gln, Arg, Ser, Thr, Val, Trp or Tyr; Xaa at position 135 is Thr, Ala, Cys, Asp, Glu, Phe, Gly, His, Ile, Lys, Leu, Met, Asn, Pro, Gln, Arg, Ser, Val, Trp or Tyr; Xaa at position 136 is Gly, Ala, Cys, Asp, Glu, Phe, His, Ile, Lys, Leu, Met, Asn, Pro, Gln, Arg, Ser, Thr, Val, Trp or Tyr; Xaa at position 137 is Asn, Ala, Cys, Asp, Glu, Phe, Gly, His, Ile, Lys, Leu, Met, Pro, Glu, Arg, Ser, Thr, Val, Trp or Tyr; Xaa at position 138 is Ile, Ala, Cys, Asp, Glu, Phe, Gly, His, Lys, Leu, Met, Asn, Pro, Gln, Arg, Ser, Thr, Val, Trp or Tyr; Xaa at position 139 is Phe, Ala, Cys, Asp, Glu, Gly, His, Ile, Lys, Leu, Met, Asn, Pro, Gln, Arg, Ser, Thr, Val, Trp or Tyr; Xaa at position 140 is Ile, Ala, Cys, Phe, His, Leu, Met, Asn, Gln, Thr, Val or Tyr; Xaa at position 142 is Val, Cys, Ile, Leu or Met; Xaa at position 143 is Val, Ile; Leu or Met; Xaa at position 145 is Lys, Val, Arg, Ile, Leu or Met; and Xaa at position 146 is Ser, Gly, Thr or Ala; and wherein, 1 to 14 amino acids are optionally deleted from the N-terminus of the polypeptide.

In some embodiments an AfIP-1A polypeptide comprises an amino acid sequence of SEQ ID NO: 257 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60, amino acid substitutions, in any combination, at residues designated by Xaa in SEQ ID NO: 257 compared to the native amino acid at the corresponding position of SEQ ID NO: 2.

In some embodiments an AfIP-1A polypeptide comprises an amino acid sequence of SEQ ID NO: 257 having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, at residues designated by Xaa in SEQ ID NO: 257 compared to the native amino acid at the corresponding position of SEQ ID NO: 2.

In some embodiments exemplary AfIP-1A polypeptides are encoded by the polynucleotide sequence set forth in SEQ ID NO: 1, SEQ ID NO: 5, SEQ ID NO: 27, SEQ ID NO: 31, SEQ ID NO: 35, SEQ ID NO: 39, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57, SEQ ID NO: 59, SEQ ID NO: 61, SEQ ID NO: 63, SEQ ID NO: 65, SEQ ID NO: 67, SEQ ID NO: 69, SEQ ID NO: 71, SEQ ID NO: 73, SEQ ID NO: 93, SEQ ID NO: 95, SEQ ID NO: 97, SEQ ID NO: 99, SEQ ID NO: 151, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 546, SEQ ID NO: 547, SEQ ID NO: 548, SEQ ID NO: 549, SEQ ID NO: 550, SEQ ID NO: 551, SEQ ID NO: 552, SEQ ID NO: 553, SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, SEQ ID NO: 587, SEQ ID NO: 588, SEQ ID NO: 589, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, and SEQ ID NO: 681.

In some embodiments exemplary AfIP-1A polypeptides are set forth in SEQ ID NO: 2, SEQ ID NO: 6, SEQ ID NO: 28, SEQ ID NO: 32, SEQ ID NO: 36, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, and SEQ ID NO: 664.

In some embodiments exemplary AfIP-1A polypeptides are the polypeptides shown in Table 9, Table 10, Table 14, Table 15, Table 16, Table 26, Table 30, Table 32, and/or Table 33 and any combinations of the amino acid substitutions thereof as well as deletions and or insertions and fragments thereof.

In some embodiments an AfIP-1A polypeptide does not have the amino acid sequence of SEQ ID NO: 18.

In some embodiments an AfIP-1A polypeptide has a calculated molecular weight of between about 8 kD and about 18 kD, between about 10 kD and about 18 kD, between about 12.kD and about 18 kD, between about 14 kD and about 18 kD, between about 15 kD and about 17 kD or between about 15.5 kD and about 16.5 kD.

In some embodiments the AfIP-1A polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the AfIP-1A polypeptide has increased digestibility of proteolytic fragments in an insect gut.

In some embodiments an AfIP-1B polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 4, SEQ ID NO: 30, SEQ ID NO: 34 or SEQ ID NO: 38. In some embodiments an AfIP-1B polypeptide has at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 4, SEQ ID NO: 30, SEQ ID NO: 34 or SEQ ID NO: 38. In some embodiments an AfIP-1B polypeptide has at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 4. In some embodiments an AfIP-1B polypeptide comprises an amino acid sequence having at least 50% identity, to the amino acid sequence of SEQ ID NO: 4, SEQ ID NO: 30, SEQ ID NO: 34 or SEQ ID NO: 38, wherein the polypeptide has insecticidal activity and/or pesticidal activity. In some embodiments an AfIP-1B polypeptide comprises an amino acid sequence having at least 80% identity, to the amino acid sequence of SEQ ID NO: 4, SEQ ID NO: 30, SEQ ID NO: 34 or SEQ ID NO: 38, wherein the polypeptide has insecticidal activity and/or pesticidal activity. In some embodiments an AfIP-1B polypeptide comprises an amino acid sequence having at least 90% identity to the amino acid sequence of SEQ ID NO: 4, wherein the polypeptide has insecticidal activity and/or pesticidal activity. In some embodiments an AfIP-1B polypeptide comprises an amino acid sequence having at least 95% identity to the amino acid sequence of SEQ ID NO: 4, wherein the polypeptide has insecticidal activity and/or pesticidal activity. In some embodiments an insecticidal polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 20.

In some embodiments an AfIP-1B polypeptide comprises one or more amino acid motifs selected from: i) amino acids 105-115 of SEQ ID NO: 4, amino acids 105-115 of SEQ ID NO: 258 or amino acids 105-115 of SEQ ID NO: 259, ii) amino acids 133-144 of SEQ ID NO: 4, amino acids 133-144 of SEQ ID NO: 258 or amino acids 133-144 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4, amino acids 358-365 of SEQ ID NO: 258 or amino acids 358-365 of SEQ ID NO: 259, and v) amino acids 511-520 of SEQ ID NO: 4, amino acids 511-520 of SEQ ID NO: 258 or amino acids 511-520 of SEQ ID NO: 259. In some embodiments the amino acid motif may optionally have a deletion of one or more amino acids within the motif, an insertion of one or more amino acids within the motif or combinations thereof.

In some embodiments the AfIP-1B polypeptide comprises an amino acid motif as represented by positions amino acids 358-365 of SEQ ID NO: 259 wherein at least one amino acid at positions 358-365 of SEQ ID NO: 259 are not identical to amino acids at positions 358-365 of SEQ ID NO: 20.

In some embodiments an AfIP-1B polypeptide comprises an amino acid sequence having at least 50% identity to the amino acid sequence set forth in SEQ ID NO: 4, SEQ ID NO: 30, SEQ ID NO: 34 or SEQ ID NO: 38. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1B polypeptide comprises an amino acid sequence having at least 80% identity to the amino acid sequence set forth in SEQ ID NO: 4, SEQ ID NO: 30, SEQ ID NO: 34 or SEQ ID NO: 38. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1B polypeptide comprises an amino acid sequence having at least 90% identity to the amino acid sequence set forth in SEQ ID NO: 4, SEQ ID NO: 30, SEQ ID NO: 34 or SEQ ID NO: 38. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1B polypeptide comprises an amino acid sequence having at least 95% identity to the amino acid sequence set forth in SEQ ID NO: 4, SEQ ID NO: 30, SEQ ID NO: 34 or SEQ ID NO: 38. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

In some embodiments an AfIP-1B polypeptide comprises an amino acid sequence having at least 50% identity to the amino acid sequence set forth in SEQ ID NO: 4, SEQ ID NO: 30, SEQ ID NO: 34 or SEQ ID NO: 38 and comprises one or more amino acid motifs selected from: i) amino acids 105-115 of SEQ ID NO: 4, amino acids 105-115 of SEQ ID NO: 258, or amino acids 105-115 of SEQ ID NO: 259, ii) amino acids 133-144 of SEQ ID NO: 4, amino acids 133-144 of SEQ ID NO: 258 or amino acids 133-144 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4, amino acids 358-365 of SEQ ID NO: 258 or amino acids 358-365 of SEQ ID NO: 259, and v) amino acids 511-520 of SEQ ID NO: 4, amino acids 511-520 of SEQ ID NO: 258 or amino acids 511-520 of SEQ ID NO: 259.

In some embodiments an AfIP-1B polypeptide comprises an amino acid sequence having at least 90% identity to the amino acid sequence set forth in SEQ ID NO: 4, SEQ ID NO: 30, SEQ ID NO: 34 or SEQ ID NO: 38 and comprises one or more amino acid motifs selected from: i) amino acids 105-115 of SEQ ID NO: 4, amino acids 105-115 of SEQ ID NO: 258, or amino acids 105-115 of SEQ ID NO: 259, ii) amino acids 133-144 of SEQ ID NO: 4, amino acids 133-144 of SEQ ID NO: 258 or amino acids 133-144 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4 or amino acids 358-365 of SEQ ID NO: 258, amino acids 358-365 of SEQ ID NO: 259, and v) amino acids 511-520 of SEQ ID NO: 4, amino acids 511-520 of SEQ ID NO: 258 or amino acids 511-520 of SEQ ID NO: 259.

In some embodiments an AfIP-1B polypeptide comprises an amino acid sequence having at least 95% identity to the amino acid sequence set forth in SEQ ID NO: 4, SEQ ID NO: 30, SEQ ID NO: 34 or SEQ ID NO: 38 and comprises one or more amino acid motifs selected from: i) amino acids 105-115 of SEQ ID NO: 4, amino acids 105-115 of SEQ ID NO: 258, or amino acids 105-115 of SEQ ID NO: 259, ii) amino acids 133-144 of SEQ ID NO: 4, amino acids 133-144 of SEQ ID NO: 258 or amino acids 133-144 of SEQ ID NO: 259, iii) amino acids 177-184 of SEQ ID NO: 4, amino acids 177-184 of SEQ ID NO: 258 or amino acids 177-184 of SEQ ID NO: 259, iv) amino acids 358-365 of SEQ ID NO: 4, amino acids 358-365 of SEQ ID NO: 258 or amino acids 358-365 of SEQ ID NO: 259, and v) amino acids 511-520 of SEQ ID NO: 4, amino acids 511-520 of SEQ ID NO: 258 or amino acids 511-520 of SEQ ID NO: 259.

In some embodiments an AfIP-1B polypeptide comprises an amino acid sequence of SEQ ID NO: 258 wherein Xaa at position 12 is Met or Leu; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly or Cys; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val, Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Gln, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val or Ala; Xaa at position 134 is Ser or Leu; Xaa at position 137 is Val, Phe, Ala, Leu, Trp, Pro, Ser, Cys Asp, Glu or Arg; Xaa at position 139 is Glu or Asp; Xaa at position 141 is Phe, Val, Leu, Ile, Trp, Ser or Cys; Xaa at position 144 is Ala or Val; Xaa at position 148 is Ser, Phe or Thr; Xaa at position 152 is Ile or Thr; Xaa at position 155 is Asp or Glu; Xaa at position 179 is Gly, Val, Trp, Ser, Cys or Arg; Xaa at position 181 is Ile, Val or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys or Phe; Xaa at position 202 is Lys or Asn; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile or Val; Xaa at position 296 is Lys or Glu; Xaa at position 298 is Ala or Glu; Xaa at position 299 is Glu or Gly; Xaa at position 300 is Ile or Val; Xaa at position 305 is Asp or Glu; Xaa at position 317 is Ala or Ser; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile or Val; Xaa at position 373 is Arg or Ser; Xaa at position 374 is Asn or Lys; Xaa at position 377 is Leu or Ile; Xaa at position 384 is Thr or Ala; Xaa at position 385 is Ile or Ser; Xaa at position 388 is Asp or Glu; Xaa at position 393 is Tyr or Phe; Xaa at position 398 is Ala or Val; Xaa at position 414 is Tyr or Phe; Xaa at position 418 is Ile or Leu; Xaa at position 419 is Ser or Asn; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr or Phe; Xaa at position 543 is Tyr or Phe; Xaa at position 544 is Lys or Arg; Xaa at position 547 is Tyr or Phe; Xaa at position 550 is Tyr or Phe; Xaa at position 552 is Asn or Ser; Xaa at position 558 is Phe or Leu; Xaa at position 600 is Met or Val; Xaa at position 602 is Met or Ile; Xaa at position 607 is Asp or Gly; Xaa at position 610 is Thr or Lys; Xaa at position 612 is Ile or Thr; Xaa at position 613 is Leu or Pro; Xaa at position 615 is Asn or Asp; Xaa at position 619 is Lys or Arg; Xaa at position 625 is Tyr or Phe; Xaa at position 631 is Ile, Val or Leu; Xaa at position 633 is Trp or Phe; Xaa at position 646 is Gln or Arg; Xaa at position 661 is Asn or Ser; Xaa at position 683 is Thr or Ala; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

In some embodiments an AfIP-1B polypeptide comprises an amino acid sequence of SEQ ID NO: 258 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69 or 70 amino acid substitutions, in any combination, at residues designated by Xaa in SEQ ID NO: 258 compared to the native amino acid at the corresponding position of SEQ ID NO: 4.

In some embodiments an AfIP-1B polypeptide comprises an amino acid sequence of SEQ ID NO: 258 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34 or 35 amino acid substitutions, in any combination, at residues designated by Xaa in SEQ ID NO: 258 compared to the native amino acid at the corresponding position of SEQ ID NO: 4.

In some embodiments an AfIP-1B polypeptide comprises an amino acid sequence of SEQ ID NO: 259, wherein Xaa at position 12 is Met, Leu, Ile or Val; Xaa at position 34 is Ile or Leu; Xaa at position 38 is Ile or Leu; Xaa at position 42 is Glu or Asp; Xaa at position 43 is Ile or Leu; Xaa at position 53 is Tyr or Phe; Xaa at position 55 is Tyr or Phe; Xaa at position 71 is Gly, Cys or Ala; Xaa at position 86 is Val or Leu; Xaa at position 94 is Tyr or Phe; Xaa at position 97 is Ile or Leu; Xaa at position 101 is Tyr or Phe; Xaa at position 103 is Ile, Leu, Gly, Val, Trp, Phe, Thr, Cys, Glu or Arg; Xaa at position 105 is Met, Gly, Val Leu, Trp, Phe, Pro, Thr, Cys, Asn, Gln or Arg; Xaa at position 106 is Ile or Leu; Xaa at position 108 is Gly, Ala, Leu, Val, Ile, Met, Trp, Phe, Ser, Thr, Cys, Tyr, Asn, Glu, Asp, Lys or His; Xaa at position 109 is Ile, Leu, Ala, Val, Leu, Met, Trp, Phe, Pro, Cys, Asn or Glu; Xaa at position 110 is Glu, Gly, Ala, Val, Leu, Met, Trp, Ser, Thr, Cys, Tyr, Asp, Arg or His; Xaa at position 111 is Tyr, Gly, Ala, Val, Leu, Ile, Met, Trp, Ser, Thr, Cys, Asp, Glu, Lys, Arg or His; Xaa at position 115 is Asp or Glu; Xaa at position 119 is Val, Ala, Ile or Leu; Xaa at position 134 is Ser or Leu; Xaa at position 137 is Val, Phe, Ala, Leu, Trp, Pro, Ser, Cys, Asp, Glu or Arg; Xaa at position 139 is Glu or Asp; Xaa at position 141 is Phe, Val, Leu, Ile, Trp, Ser or Cys; Xaa at position 144 is Ala, Val, Gly, Ile, Leu or Met; Xaa at position 148 is Ser, Phe, Thr or Trp; Xaa at position 152 is Ile, Thr, Leu, Val, Met or Ser; Xaa at position 155 is Asp or Glu; Xaa at position 179 is Gly, Val, Trp, Ser, Cys or Arg; Xaa at position 181 is Ile, Val, Met or Leu; Xaa at position 182 is Trp, Gly, Ala, Val, Leu, Met, Ser, Cys, Glu or Arg; Xaa at position 188 is Val or Leu; Xaa at position 196 is Lys or Glu; Xaa at position 197 is Thr or Ser; Xaa at position 201 is Trp, Cys, Tyr or Phe; Xaa at position 202 is Lys, Asn or Arg; Xaa at position 203 is Tyr or Phe; Xaa at position 208 is Glu or Asp; Xaa at position 214 is Ile or Leu; Xaa at position 220 is Ile or Leu; Xaa at position 224 is Tyr or Phe; Xaa at position 234 is Glu or Asp; Xaa at position 235 is Val or Leu; Xaa at position 270 is Ile, Val, Leu or Met; Xaa at position 296 is Lys or Glu; Xaa at position 298 is Ala, Glu, Gly or Asp; Xaa at position 299 is Glu, Gly, Asp or Ala; Xaa at position 300 is Ile, Val, Ile or Met; Xaa at position 305 is Asp or Glu; Xaa at position 317 is Ala, Ser, Gly or Thr; Xaa at position 323 is Glu or Asp; Xaa at position 335 is Glu or Asp; Xaa at position 352 is Glu or Asp; Xaa at position 359 is Glu, Gly, Ala, Val, Leu, Trp, Phe, Pro, Ser, Thr, Lys or Arg; Xaa at position 360 is Asn, Gly, Val, Leu, Ile, Met, Phe, Pro, Thr, Asn, Asp, Lys, Arg or His; Xaa at position 361 is Ser, Gly, Val, Leu or Glu; Xaa at position 363 is Asp, Gly, Leu, Ile, Trp or Ser; Xaa at position 364 is Val, Pro, Ser, Thr, Asn, Gln, Asp, Glu or Lys; Xaa at position 365 is Leu, Gly, Ala, Val, Ile, Trp, Phe, Pro, Ser, Thr, Cys, Tyr, Gln, Asp, Glu, Arg or His; Xaa at position 367 is Glu or Lys; Xaa at position 368 is Gly or Asp; Xaa at position 370 is Ile, Val, Leu or Met; Xaa at position 373 is Arg or Ser; Xaa at position 374 is Asn, Lys, Gln or Arg; Xaa at position 377 is Leu, Ile, Val or Met; Xaa at position 384 is Thr, Ala, Ser or Gly; Xaa at position 385 is Ile, Ser, Leu, Val, Met or Thr; Xaa at position 388 is Asp or Glu; Xaa at position 393 is Tyr, Phe or Trp; Xaa at position 398 is Ala or Val; Xaa at position 414 is Tyr or Phe; Xaa at position 418 is Ile or Leu; Xaa at position 419 is Ser, Asn, Thr or Gln; Xaa at position 423 is Val or Leu; Xaa at position 425 is Glu or Val; Xaa at position 427 is Ile or Val; Xaa at position 434 is Met or Thr; Xaa at position 481 is Glu or Asp; Xaa at position 495 is Asp or Glu; Xaa at position 509 is Phe, Gly, Ala, Val, Leu, Ile, Met, Trp, Ser, Cys, Tyr, Asn, Asp, Glu or Arg; Xaa at position 512 is Asn, Ser, Gly, Ala, Leu, Met, Trp, Phe, Ser, Thr, Cys, Gln or Arg; Xaa at position 514 is Glu, Gly, Ile, Asp or Arg; Xaa at position 516 is Gly, Ala, Val, Met, Pro, Thr, Asn, Gln, Asp, Glu or Lys; Xaa at position 519 is Leu, Gly, Ala, Val, Met, Phe, Pro, Tyr, Gln, Asp, Lys or Arg; Xaa at position 526 is Val or Leu; Xaa at position 530 is Ile or Leu; Xaa at position 533 is Val or Ala; Xaa at position 536 is Ile or Leu; Xaa at position 538 is Tyr, Phe or Trp; Xaa at position 543 is Tyr or Phe; Xaa at position 544 is Lys or Arg; Xaa at position 547 is Tyr or Phe; Xaa at position 550 is Tyr, Phe or Trp; Xaa at position 552 is Asn, Ser, Gln or Thr; Xaa at position 558 is Phe or Leu; Xaa at position 600 is Met or Val; Xaa at position 602 is Met, Ile, Leu or Val; Xaa at position 607 is Asp or Gly; Xaa at position 610 is Thr, Lys, Ser or Arg; Xaa at position 612 is Ile or Thr; Xaa at position 613 is Leu or Pro; Xaa at position 615 is Asn or Asp; Xaa at position 619 is Lys or Arg; Xaa at position 625 is Tyr, Phe or Trp; Xaa at position 631 is Ile, Val, Leu or Met; Xaa at position 633 is Trp or Phe; Xaa at position 646 is Gln or Arg; Xaa at position 661 is Asn or Ser; Xaa at position 683 is Thr, Ala, Ser or Gly; Xaa at position 696 is Glu or Asp; Xaa at position 700 is Ser or Gly; and Xaa at position 702 is Phe or Ser; and wherein, 1 to 25 amino acids are optionally deleted from the C-terminus of the polypeptide.

In some embodiments an AfIP-1B polypeptide comprises an amino acid sequence of SEQ ID NO: 259 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69 or 70 amino acid substitutions, in any combination, at residues designated by Xaa in SEQ ID NO: 259 compared to the native amino acid at the corresponding position of SEQ ID NO: 4.

In some embodiments an AfIP-1B polypeptide comprises an amino acid sequence of SEQ ID NO: 259 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34 or 35 amino acid substitutions, in any combination, at residues designated by Xaa in SEQ ID NO: 259 compared to the native amino acid at the corresponding position of SEQ ID NO: 4.

In some embodiments an AfIP-1B polypeptide comprises an amino acid sequence of SEQ ID NO: 277, wherein Xaa at position 8 is Ile or Val; Xaa at position 14 is Ile or Val; Xaa at position 16 is Val or Ile; Xaa at position 30 is Leu or Ile; Xaa at position 43 is Ile or Val; Xaa at position 47 is Met or Ile; Xaa at position 50 is Lys or Arg; Xaa at position 52 is Gln or Asn; Xaa at position 56 is Thr or Ser; Xaa at position 62 is Gly or Ala; Xaa at position 63 is Thr or Ser; Xaa at position 64 is Ile or Leu; Xaa at position 73 is Ser or Thr; Xaa at position 75 is Ile or Val; Xaa at position 76 is Ala or Ser; Xaa at position 81 is Ala or Ser; Xaa at position 83 is Ala or Ser; Xaa at position 99 is Val or Leu; Xaa at position 122 is Val or Ile; Xaa at position 135 is Leu or Val; Xaa at position 139 is Glu or Asp; Xaa at position 158 is Met or Val; Xaa at position 160 is Glu or Asp; Xaa at position 162 is Val or Leu; Xaa at position 164 is Ser or Ala; Xaa at position 166 is Gln or Asn; Xaa at position 171 is Ser or Thr; Xaa at position 173 is Gly or Ala; Xaa at position 176 is Leu or Met; Xaa at position 185 is Met or Ile; Xaa at position 191 is Glu or Asp; Xaa at position 192 is Met or Ile; Xaa at position 208 is Glu or Asp; Xaa at position 210 is Ser or Thr; Xaa at position 216 is Ser or Ala; Xaa at position 217 is Ser or Ala; Xaa at position 220 is Ile or Val; Xaa at position 233 is Ser or Thr; Xaa at position 236 is Glu or Asp; Xaa at position 241 is Ala or Ser; Xaa at position 243 is Ala or Ser; Xaa at position 263 is Ser or Ala; Xaa at position 264 is Phe or Tyr; Xaa at position 265 is Ala or Ser; Xaa at position 268 is Ser or Thr; Xaa at position 270 is Ile or Leu; Xaa at position 288 is Ile or Leu; Xaa at position 292 is Leu or Val; Xaa at position 309 is Lys or Arg; Xaa at position 313 is Ser or Thr; Xaa at position 317 is Ala or Ser; Xaa at position 318 is Leu or Ile; Xaa at position 323 is Glu or Asp; Xaa at position 332 is Leu or Met; Xaa at position 344 is Lys or Arg; Xaa at position 347 is Ile or Leu; Xaa at position 357 is Val or Leu; Xaa at position 367 is Glu or Asp; Xaa at position 393 is Tyr or Phe; Xaa at position 404 is Ser or Ala; Xaa at position 410 is Met or Leu; Xaa at position 415 is Met or Leu; Xaa at position 417 is Glu or Asp; Xaa at position 442 is Thr or Ser; Xaa at position 449 is Ala or Ser; Xaa at position 454 is Leu or Met; Xaa at position 455 is Asp or Glu; Xaa at position 461 is Ser or Ala; Xaa at position 465 is Val or Ile; Xaa at position 468 is Ser or Ala; Xaa at position 475 is Val or Ile; Xaa at position 481 is Glu or Asp; Xaa at position 486 is Val or Ile; Xaa at position 490 is Phe or Tyr; Xaa at position 496 is Glu or Asp; Xaa at position 520 is Leu or Met; Xaa at position 526 is Ile or Val; Xaa at position 530 is Ile or Val; Xaa at position 536 is Ile or Val; Xaa at position 538 is Tyr or His; Xaa at position 545 is Ala or Ser; Xaa at position 550 is Tyr or Phe; Xaa at position 559 is Ser or Ala; Xaa at position 562 is Ile or Met; Xaa at position 564 is Met or Val; Xaa at position 574 is Ile or Val; Xaa at position 585 is Arg or Lys; Xaa at position 588 is Leu or Ile; Xaa at position 592 is Met or Val; Xaa at position 603 is Lys or Arg; Xaa at position 617 is Ser or Thr; Xaa at position 634 is Arg or Lys; Xaa at position 643 is Ala or Ser; Xaa at position 666 is Thr or Ser; Xaa at position 667 is Leu or Val; Xaa at position 685 is Arg or Lys; Xaa at position 687 is Ile or Met; and Xaa at position 690 is Thr or Ser.

In some embodiments an AfIP-1B polypeptide comprises an amino acid sequence of SEQ ID NO: 277 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69 or 70 amino acid substitutions, in any combination, at residues designated by Xaa in SEQ ID NO: 277 compared to the native amino acid at the corresponding position of SEQ ID NO: 4.

In some embodiments an AfIP-1B polypeptide comprises an amino acid sequence of SEQ ID NO: 277 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34 or 35 amino acid substitutions, in any combination, at residues designated by Xaa in SEQ ID NO: 277 compared to the native amino acid at the corresponding position of SEQ ID NO: 4.

In some embodiments an AfIP-1B polypeptide comprises an amino acid sequence of SEQ ID NO: 4 wherein at position 8 the amino acid is Ile, Val, Leu or Met; at position 12 the amino acid is Met, Leu, Ile or Val; at position 14 the amino acid is Ile, Val, Leu or Met; at position 16 the amino acid is Val, Ile, Leu or Met; at position 30 the amino acid is Leu, Ile, Val or Met; at position 42 the amino acid is Glu or Asp; at position 43 the amino acid is Ile, Val, Leu or Met; at position 47 the amino acid is Met, Ile, Leu or Val; at position 50 the amino acid is Lys or Arg; at position 52 the amino acid is Gln or Asn; at position 56 the amino acid is Thr or Ser; at position 62 the amino acid is Gly or Ala; at position 63 the amino acid is Thr or Ser; at position 64 the amino acid is Ile, Leu, Val or Met; at position 71 the amino acid is Gly, Cys or Ala; at position 73 the amino acid is Ser or Thr; at position 75 the amino acid is Ile, Val, Leu or Met; at position 76 the amino acid is Ala, Ser, Gly or Thr; at position 81 the amino acid is Ala, Ser, Gly or Thr; at position 83 the amino acid is Ala, Ser, Gly or Thr; at position 99 the amino acid is Val, Leu, Ile or Met; at position 115 the amino acid is Asp or Glu; at position 119 the amino acid is Val, Ala, Ile or Leu; at position 122 the amino acid is Val, Ile, Leu or Met; at position 135 the amino acid is Leu, Val, Ile or Met; at position 139 the amino acid is Glu or Asp; at position 144 the amino acid is Ala, Val, Gly, Ile, Leu or Met; at position 148 the amino acid is Ser, Phe, Thr or Trp; at position 152 the amino acid is Ile, Thr, Leu, Val, Met or Ser; at position 155 the amino acid is Asp or Glu; at position 158 the amino acid is Met, Val, Ile or Leu; at position 160 the amino acid is Glu or Asp; at position 162 the amino acid is Val, Leu, Ile or Met; at position 164 the amino acid is Ser, Ala, Thr or Gly; at position 166 the amino acid is Gln or Asn; at position 171 the amino acid is Ser or Thr; at position 173 the amino acid is Gly or Ala; at position 176 the amino acid is Leu, Met, Ile or Val; at position 181 the amino acid is Ile, Val, Ile or Met; at position 185 the amino acid is Met, Ile, Leu or Val; at position 191 the amino acid is Glu or Asp; at position 192 the amino acid is Met, Ile, Leu or Val; at position 197 the amino acid is Thr or Ser; at position 201 the amino acid is Trp, Cys or Tyr; at position 202 the amino acid is Lys, Asn or Arg; at position 208 the amino acid is Glu or Asp; at position 210 the amino acid is Ser or Thr; at position 216 the amino acid is Ser, Ala, Thr or Gly; at position 217 the amino acid is Ser, Ala, Thr or Gly; at position 220 the amino acid is Ile, Val, Leu, Met, Ile or Val; at position 233 the amino acid is Ser or Thr; at position 234 the amino acid is Glu or Asp; at position 236 the amino acid is Glu or Asp; at position 241 the amino acid is Ala, Ser, Gly or Thr; at position 243 the amino acid is Ala, Ser, Gly or Thr; at position 263 the amino acid is Ser, Ala, Thr or Gly; at position 264 the amino acid is Phe, Tyr or Trp; at position 265 the amino acid is Ala, Ser, Gly or Thr; at position 268 the amino acid is Ser or Thr; at position 270 the amino acid is Ile, Leu, Val or Met; at position 288 the amino acid is Ile, Leu, Val or Met; at position 292 the amino acid is Leu, Val, Ile or Met; at position 298 the amino acid is Ala, Glu, Gly or Asp; at position 299 the amino acid is Glu, Gly, Asp or Ala; at position 300 the amino acid is Ile, Val, Ile or Met; at position 305 the amino acid is Asp or Glu; at position 309 the amino acid is Lys or Arg; at position 313 the amino acid is Ser or Thr; at position 317 the amino acid is Ala, Ser, Gly or Thr; at position 318 the amino acid is Leu, Ile, Val or Met; at position 323 the amino acid is Glu or Asp; at position 332 the amino acid is Leu, Met, Ile or Val; at position 335 the amino acid is Glu or Asp; at position 344 the amino acid is Lys or Arg; at position 347 the amino acid is Ile, Leu, Val or Met; at position 352 the amino acid is Glu or Asp; at position 357 the amino acid is Val, Leu, Ile or Met; at position 367 the amino acid is Glu or Asp; at position 370 the amino acid is Ile, Val, Leu or Met; at position 374 the amino acid is Asn, Lys, Gln or Arg; at position 377 the amino acid is Leu, Ile, Val or Met; at position 384 the amino acid is Thr, Ala, Ser or Gly; at position 385 the amino acid is Ile, Ser, Leu, Val, Met or Thr; at position 388 the amino acid is Asp or Glu; at position 393 the amino acid is Tyr or Phe; at position 404 the amino acid is Ser, Ala, Thr or Gly; at position 410 the amino acid is Met or Leu; at position 415 the amino acid is Met or Leu; at position 417 the amino acid is Glu or Asp; at position 419 the amino acid is Ser, Asn, Thr or Gln; at position 442 the amino acid is Thr or Ser; at position 449 the amino acid is Ala, Ser, Gly or Thr; at position 454 the amino acid is Leu, Met, Ile or Val; at position 455 the amino acid is Asp or Glu; at position 461 the amino acid is Ser, Ala, Thr or Gly; at position 465 the amino acid is Val, Ile, Leu or Met; at position 468 the amino acid is Ser, Ala, Thr or Gly; at position 475 the amino acid is Val, Ile, Leu or Met; at position 481 the amino acid is Glu or Asp; at position 486 the amino acid is Val, Ile, Leu or Met; at position 490 the amino acid is Phe, Tyr or Trp; at position 495 the amino acid is Asp or Glu; at position 496 the amino acid is Glu or Asp; at position 520 the amino acid is Leu, Met, Ile or Val; at position 526 the amino acid is Ile, Val, Leu or Met; at position 530 the amino acid is Ile, Val, Leu or Met; at position 536 the amino acid is Ile, Val, Leu or Met; at position 538 the amino acid is Tyr or Phe amino acid is; at position 545 the amino acid is Ala, Ser, Gly or Thr; at position 550 the amino acid is Tyr or Phe; at position 552 the amino acid is Asn, Ser, Gln or Thr; at position 559 the amino acid is Ser, Ala, Thr or Gly; at position 562 the amino acid is Ile or Met; at position 564 the amino acid is Met, Val, Ile or Leu; at position 574 the amino acid is Ile, Val, Leu or Met; at position 585 the amino acid is Arg or Lys; at position 588 the amino acid is Leu, Ile, Val or Met; at position 592 the amino acid is Met, Val, Ile or Leu; at position 602 the amino acid is Met, Ile, Leu or Val; at position 603 the amino acid is Lys or Arg; at position 610 the amino acid is Thr, Lys, Ser or Arg; at position 617 the amino acid is Ser or Thr; at position 619 the amino acid is Lys or Arg; at position 625 the amino acid is Tyr, Phe or Trp; at position 631 the amino acid is Ile, Val, Leu or Met; at position 634 the amino acid is Arg or Lys; at position 643 the amino acid is Ala, Ser, Gly or Thr; at position 666 the amino acid is Thr or Ser; at position 667 the amino acid is Leu, Val, Ile or Met; at position 683 the amino acid is Thr, Ala, Ser or Gly; at position 685 the amino acid is Arg or Lys; at position 687 the amino acid is Ile or Met; at position 690 the amino acid is Thr or Ser; and at position 696 the amino acid is Glu or Asp.

In some embodiments an AfIP-1B polypeptide comprises an amino acid sequence of SEQ ID NO: 4 wherein 1 to 70 amino acid positions of SEQ ID NO: 4 are substituted with the amino acid at the corresponding position of SEQ ID NO: 20 as shown in the amino acid sequence alignment of SEQ ID NO: 4 and SEQ ID NO: 20 in FIG. 4.

In some embodiments an AfIP-1B polypeptide comprises an amino acid sequence of SEQ ID NO: 4 wherein 1 to 35 amino acid positions of SEQ ID NO: 4 are substituted with the amino acid at the corresponding position of SEQ ID NO: 20 as shown in the amino acid sequence alignment of SEQ ID NO: 4 and SEQ ID NO: 20 in FIG. 4.

In some embodiments exemplary AfIP-1B polypeptides are encoded by the polynucleotide sequence set forth in SEQ ID NO: 3, SEQ ID NO: 29, SEQ ID NO: 33 or SEQ ID NO: 37 SEQ ID NO: 75, SEQ ID NO: 77, SEQ ID NO: 79, SEQ ID NO: 81, SEQ ID NO: 83, SEQ ID NO: 85, SEQ ID NO: 87, SEQ ID NO: 89, SEQ ID NO: 91, SEQ ID NO: 391, SEQ ID NO: 392, SEQ ID NO: 393, SEQ ID NO: 394, SEQ ID NO: 395, SEQ ID NO: 396, SEQ ID NO: 397, SEQ ID NO: 398, SEQ ID NO: 399, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, SEQ ID NO: 417, SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 437, SEQ ID NO: 438, SEQ ID NO: 439, SEQ ID NO: 440, SEQ ID NO: 441, SEQ ID NO: 442, SEQ ID NO: 443, SEQ ID NO: 44, SEQ ID NO: 445, SEQ ID NO: 446, SEQ ID NO: 447, SEQ ID NO: 448, SEQ ID NO: 449, SEQ ID NO: 450, SEQ ID NO: 451, SEQ ID NO: 452, SEQ ID NO: 453, SEQ ID NO: 454, SEQ ID NO: 455, SEQ ID NO: 456, SEQ ID NO: 457, SEQ ID NO: 458, SEQ ID NO: 709, SEQ ID NO: 710, SEQ ID NO: 71, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, SEQ ID NO: 723, SEQ ID NO: 724, SEQ ID NO: 725, SEQ ID NO: 726, SEQ ID NO: 727, SEQ ID NO: 728, SEQ ID NO: 729, and SEQ ID NO: 730.

In some embodiments an AfIP-1B polypeptide includes variants where an amino acid that is part of a proteolytic cleavage site is changed to another amino acid to eliminate or alter the proteolytic cleavage at that site. In some embodiments the proteolytic cleavage is by a protease in the insect gut. In other embodiments the proteolytic cleavage is by a plant protease in the transgenic plant.

In some embodiments exemplary AfIP-1B polypeptides are the polypeptides shown in Table 18, Table 20, Table 28, and/or 34, and any combinations of the amino acid substitutions thereof as well as deletions, and or insertions and fragments thereof.

In some embodiments an AfIP-1B polypeptide does not have the amino acid sequence of SEQ ID NO: 20.

In some embodiments an AfIP-1B polypeptide has a calculated molecular weight of between about 65 kD and about 85 kD, between about 67.5 kD and about 82.5 kD, between about 72.5 kD and about 80 kD, between about 75 kD and about 77.5 kD or between about 75.5 kD and about 76.5 kD.

In some embodiments the AfIP-1B polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the AfIP-1B polypeptide has increased digestibility of proteolytic fragments in an insect gut.

In some embodiments an AfIP-1B polypeptide is encoded by a nucleic acid molecule that hybridizes under stringent conditions to the nucleic acid molecule of SEQ ID NO: 4, SEQ ID NO: 29, SEQ ID NO: 33 or SEQ ID NO: 35.

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the AfIP-1A and/or AfIP-1B polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.,* 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.,* 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207:187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another aspect the AfIP-1A and/or AfIP-1B polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the AfIP-1A or AfIP-1B polypeptide and the 3' intein coding sequence is linked to the 5' end of the second fragment coding for the C-terminal part of the AfIP-1A or AfIP-1B polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol. Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387:422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In another aspect the AfIP-1A and/or AfIP-1B polypeptide is a circular permuted variant. In certain embodiments the AfIP-1A polypeptide is a circular permuted variant of the polypeptide of SEQ ID NO: SEQ ID NO: 2, SEQ ID NO: 6, SEQ ID NO: 28, SEQ ID NO: 32, SEQ ID NO: 36, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100 or SEQ ID NO: 152. In certain embodiments the AfIP-1B polypeptide is a circular permuted variant of the polypeptide of SEQ ID NO: 4, SEQ ID NO: 30, SEQ ID NO: 34 or SEQ ID NO: 38, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90 or SEQ ID NO: 92. The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted AfIP-1A or AfIP-1B polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted AfIP-1A or AfIP-1B polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another aspect fusion proteins are provided that include within its amino acid sequence an amino acid sequence comprising an AfIP-1A polypeptide including but not limited to the polypeptide of SEQ ID NO: SEQ ID NO: 2, SEQ ID NO: 6, SEQ ID NO: 28, SEQ ID NO: 32, SEQ ID NO: 36, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 94, SEQ ID NO: 96, SEQ ID NO: 98, SEQ ID NO: 100, SEQ ID NO: 152, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 648, SEQ ID NO: 649, SEQ ID NO: 650, SEQ ID NO: 651, SEQ ID NO: 652, SEQ ID NO: 653, SEQ ID NO: 654, SEQ ID NO: 655, SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, and active fragments thereof.

In another aspect fusion proteins are provided that include within its amino acid sequence an amino acid sequence comprising an AfIP-1B polypeptide including but not limited to the polypeptide of SEQ ID NO: 4, SEQ ID NO: 30, SEQ ID NO: 34 or SEQ ID NO: 38, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 687, SEQ ID NO: 688, SEQ ID NO: 689, SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO:700, SEQ ID NO: 701, SEQ ID NO: 702, SEQ ID NO: 703, SEQ ID NO: 704, SEQ ID NO: 705, SEQ ID NO: 706, SEQ ID NO: 707 and SEQ ID NO: 708 and active fragments thereof.

Methods for design and construction of fusion proteins (and polynucleotides encoding same) are known to those of skill in the art. Polynucleotides encoding an AfIP-1A and/or AfIP-1B polypeptide may be fused to signal sequences which will direct the localization of the AfIP-1A and/or AfIP-1B polypeptide to particular compartments of a prokaryotic or eukaryotic cell and/or direct the secretion of the AfIP-1A and/or AfIP-1B polypeptide of the embodiments from a prokaryotic or eukaryotic cell. For example, in *E. coli*, one may wish to direct the expression of the protein to the periplasmic space. Examples of signal sequences or proteins (or fragments thereof) to which the AfIP-1A and/or AfIP-1B polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli*, heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the AfIP-1A and/or AfIP-1B polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the AfIP-1A or AfIP-1B polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising an AfIP-1A polypeptide, and an AfIP-1B polypeptide joined by an amino acid linker.

In some embodiments fusion proteins are provided represented by a formula selected from the group consisting of:

$R^1$-L-$R^2$, $R^2$-L-$R^1$, $R^1$-$R^2$ or $R^2$-$R^1$ wherein $R^1$ is an AfIP-1A polypeptide or the polypeptide of SEQ ID NO: 18, $R^2$ is an AfIP-1B polypeptide or the polypeptide of SEQ ID NO: 20. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pill protein of the filamentous bacteriophages, e.g. bacteriophages M13 or fd (Schaller, et al., 1975). This region provides a long, flexible spacer region between two domains of the pill surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 153) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Preferred linkers of the present invention include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another aspect chimeric polypeptide are provided that are created through joining two or more portions of genes, which originally encoded separate insecticidal proteins from different species, to create a chimeric gene. The translation of the chimeric gene results in a single chimeric pesticidal polypeptide with regions, motifs or domains derived from each of the original polypeptides. In certain embodiments the chimeric protein comprises portions, motifs or domains of an AfIP-1A polypeptide and FGTW-51 (SEQ ID NO: 18) in any combination. In certain embodiments the chimeric protein comprises portions, motifs or domains of an AfIP-1B polypeptide and FGTW-52 (SEQ ID NO: 20) in any combination. In certain embodiments the chimeric protein comprises portions, motifs or domains of the AfIP-1A polypeptide of SEQ ID NO: 2 and FGTW-51 (SEQ ID NO: 18) in any combination. In certain embodiments the chimeric protein comprises portions, motifs or domains of the AfIP-1B polypeptide of SEQ ID NO: 4 and FGTW-52 (SEQ ID NO: 20) in any combination.

It is recognized that DNA sequences may be altered by various methods, and that these alterations may result in DNA sequences encoding proteins with amino acid sequences different than that encoded by the wild-type (or native) pesticidal protein. In some embodiments an AfIP-1A polypeptide may be altered in various ways including amino acid substitutions, deletions, truncations and insertions of one or more amino acids, including up to 2, 3, 4, 5, 6, 7, 8, 9, 10, 15, 20, 25, 30, 35, 40 45, 50, about 55, 60, 65, 70, 75, 80, 85, 90, 100, 105, 110, 115, 120, 125, 130, 135, 140, 145 or more amino acid substitutions, deletions and/or insertions or combinations thereof compared to SEQ ID NO: 2, SEQ ID NO: 28, SEQ ID NO: 32, SEQ ID NO: 36, SEQ ID NO: 255, SEQ ID NO: 256 or SEQ ID NO: 257. In some embodiments an AfIP-1A polypeptide comprises the deletion of 1, 2, 3, 4, 5, 6, 7, 8, 9, 10, 11, 12, 13, 14, 15 or more amino acids from the N-terminus of the AfIP-1A polypeptide relative to the amino acid position of SEQ ID NO: 2, SEQ ID NO: 28, SEQ ID NO: 32, SEQ ID NO: 36, SEQ ID NO: 255, SEQ ID NO: 256 or SEQ ID NO: 257 (e.g. SEQ ID NO: 6, SEQ ID NO: 149).

In some embodiments an AfIP-1B polypeptide may be altered in various ways including amino acid substitutions, deletions, truncations and insertions of one or more amino acids, including up to 2, 3, 4, 5, 6, 7, 8, 9, 10, 15, 20, 25, 30, 35, 40 45, 50, about 55, 60, 65, 70, 75, 80, 85, 90, 100, 105, 110, 115, 120, 125, 130, 135, 140, 145 or more amino acid substitutions, deletions and/or insertions or combinations thereof compared to SEQ ID NO: 4, SEQ ID NO: 30, SEQ ID NO: 34, SEQ ID NO: 38, SEQ ID NO: 258 or SEQ ID NO: 259. In some embodiments an AfIP-1B polypeptide comprises the deletion of 1, 2, 3, 4, 5, 6, 7, 8, 9, 10, 11, 12, 13, 14, 15, 16, 17, 18, 19, 20, 21, 22, 23, 24, 25, 26, 27, 28, 29 or more amino acids from the C-terminus of the AfIP-1B polypeptide relative to the amino acid position of SEQ ID NO: 2, SEQ ID NO: 28, SEQ ID NO: 32, SEQ ID NO: 36, SEQ ID NO: 258 or SEQ ID NO: 259.

Methods for such manipulations are generally known in the art. For example, amino acid sequence variants of an AfIP-1A or AfIP-1B polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of an AfIP-1A and AfIP-1B polypeptide to confer pesticidal activity may be improved by the use of such techniques upon the compositions of this disclosure.

For example, conservative amino acid substitutions may be made at one or more, predicted, nonessential amino acid residues. A "nonessential" amino acid residue is a residue that can be altered from the wild-type sequence of an AfIP-1A or AfIP-1B polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol. Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within .+2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

In some embodiments, the AfIP-1A polypeptide comprises an amino acid sequence of SEQ ID NO: 2 having amino acid substitutions compared to the native amino acid of SEQ ID NO: 2 at one or more residues selected from positions 6, 7, 8, 9, 10, 11, 12, 13, 16, 17, 19, 20, 23, 24, 26, 27, 29, 30, 31, 32, 33, 34, 35, 36, 37, 38, 39, 40, 41, 42, 43, 44, 45, 46, 48, 50, 51, 54, 55, 56, 57, 58, 60, 62, 66, 65, 66, 67, 68, 69, 70, 73, 74, 76, 77, 78, 79, 82, 86, 88, 89, 91, 92, 95, 96, 97, 98, 100, 101, 104, 105, 106, 111, 112, 113, 114, 115, 116, 117, 118, 119, 120, 122, 12, 124, 126, 129, 130, 131, 132, 133, 134, 135, 136, 137, 138, 139, 140, 142, 143, 145 and 146 of SEQ ID NO: 2.

In some embodiments, the AfIP-1A polypeptide comprises an amino acid sequence of SEQ ID NO: 2 having one or more amino acid substitution(s) compared to the native amino acid of SEQ ID NO: 2 at 1 to 29 residues selected from positions 6, 7, 8, 9, 10, 11, 12, 13, 14, 16, 17, 19, 20, 23, 24, 26, 27, 29, 30, 31, 32, 33, 34, 35, 36, 37, 38, 39, 40, 41, 42, 43, 44, 45, 46, 47, 48, 50, 51, 54, 55, 56, 57, 58, 60, 61, 62, 64, 65, 66, 67, 68, 69, 70, 73, 74, 76, 77, 78, 79, 82, 86, 88, 89, 91, 92, 95, 96, 97, 98, 100, 101, 104, 105, 106, 111, 112, 113, 114, 115, 116, 117, 118, 119, 120, 122, 123, 124, 125, 126, 128, 129, 130, 131, 132, 133, 134, 135, 136, 137, 138, 139, 140, 142, 143, 145 and 146 of SEQ ID NO: 2.

In some embodiments, the AfIP-1B polypeptide comprises an amino acid sequence of SEQ ID NO: 4 having one or more amino acid substitution(s) compared to the native amino acid of SEQ ID NO: 4 at one or more residues selected from positions 12, 42, 71, 115, 119, 139, 144, 148, 152, 155, 181, 197, 201, 202, 208, 234, 270, 298, 299, 300, 305, 317, 323, 335, 352, 370, 374, 377, 384, 385, 388, 393, 419, 481, 495, 538, 550, 552, 602, 610, 619, 625, 631, 683 and 696, of SEQ ID NO: 4.

In specific embodiments, the substitution is an alanine for the native amino acid at the recited position(s). Also encompassed are the nucleic acid sequence(s) encoding the variant protein or polypeptide.

Variant nucleotide and amino acid sequences of the disclosure also encompass sequences derived from mutagenic and recombinogenic procedures such as DNA shuffling. With such a procedure, one or more different AfIP-1A or AfIP-1B polypeptide coding regions can be used to create a new AfIP-1A or AfIP-1B polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered AfIP-1A or AfIP-1B polypeptides. Domains may be swapped between AfIP-1A or AfIP-1B polypeptides, resulting in hybrid or chimeric toxins with improved pesticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Both DNA shuffling and site directed mutagenesis were used to define polypeptide sequences that possess pesticidal activity. In Examples 8 and 11 DNA shuffling was used to generate a library of active variants by recombination of the diversity present in AfIP-1A-31 (SEQ ID NO: 2) and AfIP-1B-32 (SEQ ID NO: 4) respectively. The person skilled in the art will be able to use comparisons to other proteins or functional assays to further define motifs. High throughput screening can be used to test variations of those motifs to determine the role of specific residues. Given that knowledge for several motifs, one can then define the requirements for a functional protein. Knowledge of the motifs allows the skilled artisan to design sequence variations that would not impact function.

Alignment of homologues of AfIP-1A homologs and AfIP-1B homologs (FIGS. 1 and 3, and FIG. 2 respectively) allowed identification of residues that are highly conserved among natural homologues in this family (FIG. 1). In Example 9 and 12, saturation mutagenesis was used to make and test substitutions at selected amino acid positions in the motifs at conserved residues. These mutants were tested for activity and a number of active substitutions not present among the homologues were identified providing an understanding of the functional constraints at these residues.

Compositions

Compositions comprising an AfIP-1A and/or AfIP-1B polypeptide are also embraced. In some embodiments the composition comprises an AfIP-1A polypeptide. In some embodiments the composition comprises an AfIP-1B polypeptide. In some embodiments the composition comprises an AfIP-1A polypeptide and an AfIP-1B polypeptide. In some embodiments the composition comprises an AfIP-1A/AfIP-1B fusion protein.

Antibodies

Antibodies to an AfIP-1A or AfIP-1B polypeptide of the embodiments or to variants or fragments thereof are also encompassed. The antibodies of the invention include polyclonal and monoclonal antibodies as well as fragments thereof which retain their ability to bind to AfIP-1A or AfIP-1B proteins found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present invention are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. AfIP-1A polypeptide or AfIP-1B polypeptide antibodies or antigen-binding portions thereof can be produced by a variety of techniques, including conventional monoclonal antibody methodology, for example the standard somatic cell hybridization technique of Kohler and Milstein, (1975) *Nature* 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing an AfIP-1A polypeptide or AfIP-1B polypeptide as antigens.

A kit for detecting the presence of an AfIP-1A polypeptide or AfIP-1B polypeptide, or detecting the presence of a nucleotide sequence encoding an AfIP-1A polypeptide or AfIP-1B polypeptide, in a sample is provided. In one embodiment, the kit provides antibody-based reagents for detecting the presence of an AfIP-1A polypeptide or AfIP-1B polypeptide in a tissue sample. In another embodiment, the kit provides labeled nucleic acid probes useful for detecting the presence of one or more polynucleotides encoding AfIP-1A polypeptide(s) or AfIP-1B polypeptide(s). The kit is provided along with appropriate reagents and controls for carrying out a detection method, as well as instructions for use of the kit.

Receptor Identification and Isolation

Receptors to the AfIP-1A and/or AfIP-1B polypeptide of the embodiments or to variants or fragments thereof, are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the PIP-1 polypeptides using the brush-border membrane vesicles from susceptible insects. In addition to the radioactive labeling method listed in the cited literatures, PIP-1 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled AfIP-1A and/or AfIP-1B polypeptides can be incubated with blotted membrane of BBMV and labeled the AfIP-1A and/or AfIP-1B polypeptides can be identified with the labeled reporters. Identification of protein band(s) that interact with the AfIP-1A and/or AfIP-1B polypeptides can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the AfIP-1A and/or AfIP-1B polypeptides. Receptor function for insecticidal activity by the AfIP-1A and/or AfIP-1B polypeptides can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the AfIP-1A and/or AfIP-1B polypeptide gene sequence to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Ce*l164:671-674; Sanfacon, et al., (1991) *Genes Dev.* 5:141-149; Mogen, et al., (1990) *Plant Ce*l12:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, herein incorporated by reference.

In some embodiments the recombinant nucleic acid molecule encoding an AfIP-1A or AfIP-1B polypeptide has maize optimized codons. In some embodiments the maize optimized recombinant nucleic acid molecule encoding an AfIP-1A or AfIP-1B polypeptide is selected from but not limited to SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, and SEQ ID NO: 300.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are protolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present invention. About 80 proteins from *Arabidopsis*, as well as homologous proteins from spinach and garden pea, are reported by Kieselbach et al., *Photosynthesis Research,* 78:249-264, 2003. In particular, table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present invention.

Suitable chloroplast transit peptides (CTP) are well known to one skilled in the art also include chimeric CTPs comprising but not limited to, an N-terminal domain, a central domain or a C-terminal domain from a CTP from *Oryza sativa* 1-deoxy-D xyulose-5-Phosphate Synthase *oryza sativa*-Superoxide dismutase *oryza sativa*-soluble starch synthase *oryza sativa*-NADP-dependent Malic acid enzyme *oryza sativa*-Phospho-2-dehydro-3-deoxyheptonate Aldolase 2 *oryza sativa*-L-Ascorbate peroxidase 5 *oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type US Patent Application Publication 2012/0304336).

In some embodiments the AfIP-1A and AfIP-1B polypeptides are expressed from separate genes, the skilled artisan will understand that the two components can be functionally linked to different intracellular targeting signals of the type discussed above such that the AfIP-1A and AfIP-1B polypeptides are expressed and/or stored in different intracellular compartments. In some embodiments either the AfIP-1A or AfIP-1B polypeptide might be expressed from a chimeric gene in which the coding sequence is functionally linked to a plastid transit peptide, such that the polypeptide is localized in the plastid [e.g. in a green tissue, the chloroplast], while the other polypeptide is expressed using a targeting signal such that the polypeptide is located in the vacuole, the apoplast or the cytoplasm. The AfIP-1A and AfIP-1B are thus separated in the intact cell, but come together when cell membranes are disrupted, for example due to the action of insects, fungi or other pathogens.

The AfIP-1A and/or AfIP-1B polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) Science 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Ce*111:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant. Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced AfIP-1A and/or AfIP-1B polypeptide expression within a particular plant tissue. Tissue-preferred promoters include those discussed in Yamamoto, et al., (1997) *Plant J.* 12(2):255-265; Kawamata, et al., (1997) *Plant Cell Physiol.* 38(7):792-803; Hansen, et al., (1997) *Mol. Gen. Genet.* 254(3):337-343; Russell, et al., (1997) *Transgenic Res.* 6(2):157-168; Rinehart, et al., (1996) *Plant Physiol.* 112(3): 1331-1341; Van Camp, et al., (1996) *Plant Physiol.* 112(2): 525-535; Canevascini, et al., (1996) *Plant Physiol.* 112(2): 513-524; Yamamoto, et al., (1994) *Plant Cell Physiol.* 35(5):773-778; Lam, (1994) *Results Probl. Cell Differ.* 20:181-196; Orozco, et al., (1993) *Plant Mol. Biol.* 23(6): 1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference).

Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) *Ph.D. Thesis*, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) *Ph.D. Thesis*, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ*

*Culture: Fundamental Methods*, ed. Gamborg and Phillips, (Springer-Verlag, Berlin) and McCabe, et al., (1988) *Biotechnology* 6:923-926) and Lecl transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, N.Y.), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the AfIP-1A and/or AfIP-1B polypeptide or variants and fragments thereof directly into the plant or the introduction of the AfIP-1A and/or AfIP-1B polypeptide transcript into the plant. Such methods include, for example, microinjection or particle bombardment. See, for example, Crossway, et al., (1986) *Mol. Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784, all of which are herein incorporated by reference. Alternatively, the AfIP-1A and/or AfIP-1B polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired AfIP-1A and/or AfIP-1B polypeptide. It is also recognized that such a viral polyprotein, comprising at least a portion of the amino acid sequence of an AfIP-1A and/or AfIP-1B polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassaya (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), *macadamia* (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccineffia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore *paspalum* (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mungbean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the AfIP-1A or AfIP-1B polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the AfIP-1A and/or AfIP-1B polypeptides disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262:1432 (tomato Pto gene for resistance to *Pseudomonas syringae* pv. tomato encodes a protein kinase); Mindrinos, et al., (1994) *Cell* 78:1089 (Arabidopsis RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens,* 7:1-13), from *Pseudomonas* protegens strain CHA0 and Pf-5 (previously fluorescens) (Pechy-Tarr, (2008) *Environmental Microbiology* 10:2368-2386: Gen Bank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. No. 6,048,838, and U.S. Pat. No. 6,379,946; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51 and Cry55 classes of δ-endotoxin genes and the *B. thuringiensis* cytolytic Cyt1 and Cyt2 genes. Members of these classes of *B. thuringiensis* insecticidal proteins include, but are not limited to Cry1Aa1 (Accession #Accession #M11250), Cry1Aa2 (Accession #M10917), Cry1Aa3 (Accession #D00348), Cry1Aa4 (Accession #X13535), Cry1Aa5 (Accession #D17518), Cry1Aa6 (Accession #U43605), Cry1Aa7 (Accession #AF081790), Cry1Aa8 (Accession #I26149), Cry1Aa9 (Accession #AB026261), Cry1Aa10 (Accession #AF154676), Cry1Aa11 (Accession #Y09663), Cry1Aa12 (Accession #AF384211), Cry1Aa13 (Accession #AF510713), Cry1Aa14 (Accession #AY197341), Cry1Aa15 (Accession #DQ062690), Cry1Ab1 (Accession #M13898), Cry1Ab2 (Accession #M12661), Cry1Ab3 (Accession #M15271), Cry1Ab4 (Accession #D00117), Cry1Ab5 (Accession #X04698), Cry1Ab6 (Accession #M37263), Cry1Ab7 (Accession #X13233), Cry1Ab8 (Accession #M16463), Cry1Ab9 (Accession #X54939), Cry1Ab10 (Accession #A29125), Cry1Ab11 (Accession #I12419), Cry1Ab12 (Accession #AF059670), Cry1Ab13 (Accession #AF254640), Cry1Ab14 (Accession #U94191), Cry1Ab15 (Accession #AF358861), Cry1Ab16 (Accession #AF375608), Cry1Ab17 (Accession #AAT46415), Cry1Ab18 (Accession #AAQ88259), Cry1Ab19 (Accession #AY847289), Cry1Ab20 (Accession #DQ241675), Cry1Ab21 (Accession #EF683163), Cry1Ab22 (Accession #ABW87320), Cry1Ab-like (Accession #AF327924), Cry1Ab-like (Accession #AF327925), Cry1Ab-like (Accession #AF327926), Cry1Ab-like (Accession #DQ781309), Cry1Ac1 (Accession #M11068), Cry1Ac2 (Accession #M35524), Cry1Ac3 (Accession #X54159), Cry1Ac4 (Accession #M73249), Cry1Ac5 (Accession #M73248), Cry1Ac6 (Accession #U43606), Cry1Ac7 (Accession #U87793), Cry1Ac8 (Accession #U87397), Cry1Ac9 (Accession #U89872), Cry1Ac10 (Accession #AJ002514), Cry1Ac11 (Accession #AJ130970), Cry1Ac12 (Accession #I12418), Cry1Ac13 (Accession #AF148644), Cry1Ac14 (Accession #AF492767), Cry1Ac15 (Accession #AY122057), Cry1Ac16 (Accession #AY730621), Cry1Ac17 (Accession #AY925090), Cry1Ac18 (Accession #DQ023296), Cry1Ac19 (Accession #DQ195217), Cry1Ac20 (Accession #DQ285666), Cry1Ac21 (Accession #DQ062689), Cry1Ac22 (Accession #EU282379), Cry1Ac23 (Accession #AM949588), Cry1Ac24 (Accession #ABL01535), Cry1Ad1 (Accession #M73250), Cry1Ad2 (Accession #A27531), Cry1Ae1 (Accession #M65252), Cry1Af1 (Accession #U82003), Cry1Ag1 (Accession #AF081248), Cry1Ah1 (Accession #AF281866), Cry1Ah2 (Accession #DQ269474), Cry1Ai1 (Accession #AY174873), Cry1A-like (Accession #AF327927), Cry1Ba1 (Accession #X06711), Cry1Ba2 (Accession #X95704), Cry1Ba3 (Accession #AF368257), Cry1Ba4 (Accession #AF363025), Cry1Ba5 (Accession #AB020894), Cry1Ba6 (Accession #ABL60921), Cry1Bb1 (Accession #L32020), Cry1Bc1 (Accession #Z46442), Cry1Bd1 (Accession #U70726), Cry1Bd2 (Accession #AY138457), Cry1Be1 (Accession #AF077326), Cry1Be2 (Accession #AAQ52387), Cry1Bf1 (Accession #AX189649), Cry1Bf2 (Accession #AAQ52380), Cry1Bg1 (Accession #AY176063), Cry1Ca1 (Accession #X07518), Cry1Ca2 (Accession #X13620), Cry1Ca3 (Accession #M73251), Cry1Ca4 (Accession #A27642), Cry1Ca5 (Accession #X96682), Cry1Ca6 [1] (Accession #AF215647), Cry1Ca7 (Accession #AY015492), Cry1Ca8 (Accession #AF362020), Cry1Ca9 (Accession #AY078160), Cry1Ca10 (Accession #AF540014), Cry1Ca11 (Accession #AY955268), Cry1Cb1 (Accession #M97880), Cry1Cb2 (Accession #AY007686), Cry1Cb3 (Accession #EU679502), Cry1Cb-like (Accession #AAX63901), Cry1Da1 (Accession #X54160), Cry1Da2 (Accession #I76415), Cry1Db1 (Accession #Z22511), Cry1 Db2 (Accession #AF358862), Cry1 Dc1 (Accession #EF059913), Cry1Ea1 (Accession #X53985), Cry1Ea2 (Accession #X56144), Cry1Ea3 (Accession #M73252), Cry1Ea4 (Accession #U94323), Cry1Ea5 (Accession #A15535), Cry1Ea6 (Accession #AF202531), Cry1 Ea7 (Accession #AAW72936), Cry1 Ea8 (Accession #ABX11258), Cry1Eb1 (Accession #M73253), Cry1Fa1 (Accession #M63897), Cry1Fa2 (Accession #M73254), Cry1Fb1 (Accession #Z22512), Cry1Fb2 (Accession #AB012288), Cry1Fb3 (Accession #AF062350), Cry1Fb4 (Accession #I73895), Cry1Fb5 (Accession #AF336114), Cry1Fb6 (Accession #EU679500), Cry1Fb7 (Accession #EU679501), Cry1Ga1 (Accession #Z22510), Cry1Ga2 (Accession #Y09326), Cry1Gb1 (Accession #U70725), Cry1Gb2 (Accession #AF288683), Cry1Gc (Accession #AAQ52381), Cry1Ha1 (Accession #Z22513), Cry1Hb1 (Accession #U35780), Cry1H-like (Accession #AF182196), Cry1Ia1 (Accession #X62821), Cry1Ia2 (Accession #M98544), Cry1Ia3 (Accession #L36338), Cry1Ia4 (Accession #L49391), Cry1Ia5 (Accession #Y08920), Cry1Ia6

(Accession #AF076953), Cry1Ia7 (Accession #AF278797), Cry1Ia8 (Accession #AF373207), Cry1Ia9 (Accession #AF521013), Cry1Ia10 (Accession #AY262167), Cry1Ia11 (Accession #AJ315121), Cry1Ia12 (Accession #AAV53390), Cry1Ia13 (Accession #ABF83202), Cry1Ia14 (Accession #EU887515), Cry1Ib1 (Accession #U07642), Cry1Ib2 (Accession #ABW88019), Cry1Ib3 (Accession #EU677422), Cry1Ic1 (Accession #AF056933), Cry1Ic2 (Accession #AAE71691), Cry1Id1 (Accession #AF047579), Cry1Ie1 (Accession #AF211190), Cry1If1 (Accession #AAQ52382), Cry1I-like (Accession #I90732), Cry1I-like (Accession #DQ781310), Cry1Ja1 (Accession #L32019), Cry1Jb1 (Accession #U31527), Cry1Jc1 (Accession #I90730), Cry1Jc2 (Accession #AAQ52372), Cry1Jd1 (Accession #AX189651), Cry1Ka1 (Accession #U28801), Cry1La1 (Accession #AAS60191), Cry1-like (Accession #I90729), Cry2Aa1 (Accession #M31738), Cry2Aa2 (Accession #M23723), Cry2Aa3 (Accession #D86064), Cry2Aa4 (Accession #AF047038), Cry2Aa5 (Accession #AJ 132464), Cry2Aa6 (Accession #AJ 132465), Cry2Aa7 (Accession #AJ132463), Cry2Aa8 (Accession #AF252262), Cry2Aa9 (Accession #AF273218), Cry2Aa10 (Accession #AF433645), Cry2Aa11 (Accession #AAQ52384), Cry2Aa12 (Accession #DQ977646), Cry2Aa13 (Accession #ABL01536), Cry2Aa14 (Accession #ACF04939), Cry2Ab1 (Accession #M23724), Cry2Ab2 (Accession #X55416), Cry2Ab3 (Accession #AF164666), Cry2Ab4 (Accession #AF336115), Cry2Ab5 (Accession #AF441855), Cry2Ab6 (Accession #AY297091), Cry2Ab7 (Accession #DQ119823), Cry2Ab8 (Accession #DQ361266), Cry2Ab9 (Accession #DQ341378), Cry2Ab10 (Accession #EF157306), Cry2Ab11 (Accession #AM691748), Cry2Ab12 (Accession #ABM21764), Cry2Ab13 (Accession #EU909454), Cry2Ab14 (Accession #EU909455), Cry2Ac1 (Accession #X57252), Cry2Ac2 (Accession #AY007687), Cry2Ac3 (Accession #AAQ52385), Cry2Ac4 (Accession #DQ361267), Cry2Ac5 (Accession #DQ341379), Cry2Ac6 (Accession #DQ359137), Cry2Ac7 (Accession #AM292031), Cry2Ac8 (Accession #AM421903), Cry2Ac9 (Accession #AM421904), Cry2Ac10 (Accession #BI 877475), Cry2Ac11 (Accession #AM689531), Cry2Ac12 (Accession #AM689532), Cry2Ad1 (Accession #AF200816), Cry2Ad2 (Accession #DQ358053), Cry2Ad3 (Accession #AM268418), Cry2Ad4 (Accession #AM490199), Cry2Ad5 (Accession #AM765844), Cry2Ae1 (Accession #AAQ52362), Cry2Af1 (Accession #EF439818), Cry2Ag (Accession #ACH91610), Cry2Ah (Accession #EU939453), Cry3Aa1 (Accession #M22472), Cry3Aa2 (Accession #J02978), Cry3Aa3 (Accession #Y00420), Cry3Aa4 (Accession #M30503), Cry3Aa5 (Accession #M37207), Cry3Aa6 (Accession #U10985), Cry3Aa7 (Accession #AJ237900), Cry3Aa8 (Accession #AAS79487), Cry3Aa9 (Accession #AAWO5659), Cry3Aa10 (Accession #AAU29411), Cry3Aa11 (Accession #AY882576), Cry3Aa12 (Accession #ABY49136), Cry3Ba1 (Accession #X17123), Cry3Ba2 (Accession #A07234), Cry3Bb1 (Accession #M89794), Cry3Bb2 (Accession #U31633), Cry3Bb3 (Accession #I15475), Cry3Ca1 (Accession #X59797), Cry4Aa1 (Accession #Y00423), Cry4Aa2 (Accession #D00248), Cry4Aa3 (Accession #AL731825), Cry4A-like (Accession #DQ078744), Cry4Ba1 (Accession #X07423), Cry4Ba2 (Accession #X07082), Cry4Ba3 (Accession #M20242), Cry4Ba4 (Accession #D00247), Cry4Ba5 (Accession #AL731825), Cry4Ba-like (Accession #ABC47686), Cry4Ca1 (Accession #EU646202), Cry5Aa1 (Accession #L07025), Cry5Ab1 (Accession #L07026), Cry5Ac1 (Accession #I34543), Cry5Ad1 (Accession #EF219060), Cry5Ba1 (Accession #U19725), Cry5Ba2 (Accession #EU121522), Cry6Aa1 (Accession #L07022), Cry6Aa2 (Accession #AF499736), Cry6Aa3 (Accession #DQ835612), Cry6Ba1 (Accession #L07024), Cry7Aa1 (Accession #M64478), Cry7Ab1 (Accession #U04367), Cry7Ab2 (Accession #U04368), Cry7Ab3 (Accession #BI 1015188), Cry7Ab4 (Accession #EU380678), Cry7Ab5 (Accession #ABX9555), Cry7Ab6 (Accession #FJ194973), Cry7Ba1 (Accession #ABB70817), Cry7Ca1 (Accession #EF486523), Cry8Aa1 (Accession #U04364), Cry8Ab1 (Accession #EU044830), Cry8Ba1 (Accession #U04365), Cry8Bb1 (Accession #AX543924), Cry8Bc1 (Accession #AX543926), Cry8Ca1 (Accession #U04366), Cry8Ca2 (Accession #AAR98783), Cry8Ca3 (Accession #EU625349), Cry8Da1 (Accession #AB089299), Cry8Da2 (Accession #BD133574), Cry8Da3 (Accession #BD133575), Cry8 Db1 (Accession #AB303980), Cry8Ea1 (Accession #AY329081), Cry8Ea2 (Accession #EU047597), Cry8Fa1 (Accession #AY551093), Cry8Ga1 (Accession #AY590188), Cry8Ga2 (Accession #DQ318860), Cry8Ga3 (Accession #FJ198072), Cry8Ha1 (Accession #EF465532), Cry81a1 (Accession #EU381044), Cry8Ja1 (Accession #EU625348), Cry8 like (Accession #ABS53003), Cry9Aa1 (Accession #X58120), Cry9Aa2 (Accession #X58534), Cry9Aa like (Accession #AAQ52376), Cry9Ba1 (Accession #X75019), Cry9Bb1 (Accession #AY758316), Cry9Ca1 (Accession #Z37527), Cry9Ca2 (Accession #AAQ52375), Cry9Da1 (Accession #D85560), Cry9Da2 (Accession #AF042733), Cry9 Db1 (Accession #AY971349), Cry9Ea1 (Accession #AB011496), Cry9Ea2 (Accession #AF358863), Cry9Ea3 (Accession #EF157307), Cry9Ea4 (Accession #EU760456), Cry9Ea5 (Accession #EU789519), Cry9Ea6 (Accession #EU887516), Cry9Eb1 (Accession #AX189653), Cry9Ec1 (Accession #AF093107), Cry9Ed1 (Accession #AY973867), Cry9 like (Accession #AF093107), Cry10Aa1 (Accession #M12662), Cry10Aa2 (Accession #E00614), Cry10Aa3 (Accession #AL731825), Cry10A like (Accession #DQ167578), Cry1lAa1 (Accession #M31737), Cry1lAa2 (Accession #M22860), Cry1lAa3 (Accession #AL731825), Cry1lAa-like (Accession #DQ166531), Cry11Ba1 (Accession #X86902), Cry11Bb1 (Accession #AF017416), Cry12Aa1 (Accession #L07027), Cry13Aa1 (Accession #L07023), Cry14Aa1 (Accession #U13955), Cry15Aa1 (Accession #M76442), Cry16Aa1 (Accession #X94146), Cry17Aa1 (Accession #X99478), Cry18Aa1 (Accession #X99049), Cry18Ba1 (Accession #AF169250), Cry18Ca1 (Accession #AF169251), Cry19Aa1 (Accession #Y07603), Cry19Ba1 (Accession #D88381), Cry20Aa1 (Accession #U82518), Cry21Aa1 (Accession #I32932), Cry21Aa2 (Accession #I66477), Cry21Ba1 (Accession #AB088406), Cry22Aa1 (Accession #134547), Cry22Aa2 (Accession #AX472772), Cry22Aa3 (Accession #EU715020), Cry22Ab1 (Accession #AAK50456), Cry22Ab2 (Accession #AX472764), Cry22Ba1 (Accession #AX472770), Cry23Aa1 (Accession #AAF76375), Cry24Aa1 (Accession #U88188), Cry24Ba1 (Accession #BAD32657), Cry24Ca1 (Accession #AM158318), Cry25Aa1 (Accession #U88189), Cry26Aa1 (Accession #AF122897), Cry27Aa1 (Accession #AB023293), Cry28Aa1 (Accession #AF132928), Cry28Aa2 (Accession #AF285775), Cry29Aa1 (Accession #AJ251977), Cry30Aa1 (Accession #AJ251978), Cry30Ba1 (Accession #BAD00052), Cry30Ca1 (Accession #BAD67157), Cry30Da1 (Accession #EF095955), Cry30 Db1 (Accession #BAE80088), Cry30Ea1 (Accession #EU503140), Cry30Fa1 (Accession #EU751609), Cry30Ga1 (Accession #EU882064), Cry31Aa1 (Accession #AB031065), Cry31Aa2 (Accession #AY081052), Cry31Aa3 (Accession #AB250922), Cry31Aa4 (Accession #AB274826), Cry31Aa5 (Accession #AB274827), Cry31Ab1 (Accession #AB250923), Cry31Ab2 (Accession #AB274825), Cry31Ac1 (Accession #AB276125), Cry32Aa1 (Accession #AY008143), Cry32Ba1 (Accession #BAB78601), Cry32Ca1 (Accession #BAB78602), Cry32Da1 (Accession #BAB78603), Cry33Aa1 (Accession #AAL26871), Cry34Aa1 (Accession #AAG50341), Cry34Aa2 (Accession #AAK64560), Cry34Aa3 (Accession #AY536899), Cry34Aa4 (Accession #AY536897), Cry34Ab1 (Accession #AAG41671), Cry34Ac1 (Accession #AAG50118), Cry34Ac2 (Accession #AAK64562), Cry34Ac3 (Accession #AY536896), Cry34Ba1 (Accession #AAK64565), Cry34Ba2 (Accession #AY536900), Cry34Ba3 (Accession #AY536898), Cry35Aa1 (Accession #AAG50342), Cry35Aa2 (Accession #AAK64561), Cry35Aa3 (Accession #AY536895), Cry35Aa4 (Accession #AY536892), Cry35Ab1 (Accession #AAG41672), Cry35Ab2 (Accession #AAK64563), Cry35Ab3 (Accession #AY536891), Cry35Ac1 (Accession #AAG50117), Cry35Ba1 (Accession #AAK64566), Cry35Ba2 (Accession #AY536894), Cry35Ba3 (Accession #AY536893), Cry36Aa1 (Accession #AAK64558), Cry37Aa1 (Accession #AAF76376), Cry38Aa1 (Accession #AAK64559), Cry39Aa1 (Accession #BAB72016), Cry40Aa1 (Accession #BAB72018), Cry40Ba1 (Accession #BAC77648), Cry40Ca1 (Accession #EU381045), Cry40Da1 (Accession #EU596478), Cry41Aa1 (Accession #AB116649), Cry41Ab1 (Accession #AB116651), Cry42Aa1 (Accession #AB116652), Cry43Aa1 (Accession #AB115422), Cry43Aa2 (Accession #AB176668), Cry43Ba1 (Accession #AB115422), Cry43-like (Accession #AB115422), Cry44Aa (Accession #BAD08532), Cry45Aa (Accession #BAD22577), Cry46Aa (Accession #BAC79010), Cry46Aa2 (Accession #BAG68906), Cry46Ab (Accession #BAD35170), Cry47Aa (Accession #AY950229), Cry48Aa (Accession #AJ841948), Cry48Aa2 (Accession #AM237205), Cry48Aa3 (Accession #AM237206), Cry48Ab (Accession #AM237207), Cry48Ab2 (Accession #AM237208), Cry49Aa (Accession #AJ841948), Cry49Aa2 (Accession #AM237201), Cry49Aa3 (Accession #AM237203), Cry49Aa4 (Accession #AM237204), Cry49Ab1 (Accession #AM237202), Cry50Aa1 (Accession #AB253419), Cry51Aa1 (Accession #DQ836184), Cry52Aa1 (Accession #EF613489), Cry53Aa1 (Accession #EF633476), Cry54Aa1 (Accession #EU339367), Cry55Aa1 (Accession #EU121521), Cry55Aa2 (Accession #AAE33526).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103,247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum.*

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 5,094,945, 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and International Publications EP 1173580; WO 2001/66704; EP 1173581 and EP 1173582, which are incorporated herein by reference for this purpose.

Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al.; De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+genes) and a benzonitrile (nitrilase gene). Przibilla, et al., (1991) *Plant Cell* 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluoroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtl) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mil ps, various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391,348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N-Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gln recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177,275 and 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events in Table 1A-1F.

TABLE 1A

| *Triticum aestivum* Wheat | | |
|---|---|---|
| Event | Company | Description |
| AP205CL | BASF Inc. | Selection for a mutagenized version of the enzyme acetohydroxyacid synthase (AHAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |

TABLE 1B

| *Glycine max* L. Soybean | | |
|---|---|---|
| Event | Company | Description |
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega-6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetlytransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |
| GU262 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| MON87701 | Monsanto Company | Resistance to Lepidopteran pests of soybean including velvetbean caterpillar (*Anticarsia gemmatalis*) and soybean looper (*Pseudoplusia includens*). |
| MON87701 × MON89788 | Monsanto Company | Glyphosate herbicide tolerance through expression of the EPSPS encoding gene from *A. tumefaciens* strain CP4, and resistance to Lepidopteran pests of soybean including velvetbean caterpillar (*Anticarsia gemmatalis*) and soybean looper (*Pseudoplusia includens*) via expression of the Cry1Ac encoding gene from *B. thuringiensis*. |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |
| OT96-15 | Agriculture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience(AgrEvo)) | Glufosinate ammonium herbicide tolerant soybean produced by inserting a modified phosphinothricin acetyltransferase (PAT) encoding gene from the soil bacterium *Streptomyces hygroscopicus*. |

TABLE 1C

| *Helianthus annuus* Sunflower | | |
|---|---|---|
| Event | Company | Description |
| X81359 | BASF Inc. | Tolerance to imidazolinone herbicides by selection of a naturally occurring mutant. |

TABLE 1D

| Medicago sativa Alfalfa | | |
|---|---|---|
| Event | Company | Description |
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 1E

| Oryza sativa Rice | | |
|---|---|---|
| Event | Company | Description |
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer CropScience (Aventis CropScience(AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 1F

| Zea mays L. Maize | | |
|---|---|---|
| Event | Company | Description |
| 176 | Syngenta Seeds, Inc. | Insect-resistant maize produced by inserting the Cry1Ab gene from *Bacillus thuringiensis* subsp. *kurstaki*. The genetic modification affords resistance to attack by the European corn borer (ECB). |
| 3751IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the Cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OOO21-9). |
| BT11 × MIR162 | Syngenta Seeds, Inc. | Stacked insect resistant and herbicide tolerant maize produced by conventional cross breeding of |

TABLE 1F-continued

| Zea mays L. Maize | | |
|---|---|---|
| Event | Company | Description |
| | | parental lines BT11 (OECD unique identifier: SYN-BTO11-1) and MIR162 (OECD unique identifier: SYN-IR162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. |
| BT11 × MIR162 × MIR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYN-BTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-IR6O4-5). |
| BT11 × MIR162 × MIR604 × GA21 | Syngenta Seeds, Inc. | Resistance to Coleopteran pests, particularly corn rootworm pests (*Diabrotica* spp.) and several Lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-IR6O5-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-IR6O5-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. Tolerance to glyphosate herbicide is derived from GA21 which contains a a modified EPSPS gene from maize. |
| CBH-351 | Aventis CropScience | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW AgroSciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus*. |
| DAS-59122-7 | DOW AgroSciences LLC and Pioneer Hi- | Corn rootworm-resistant maize produced by inserting the Cry34Ab1 and Cry35Ab1 genes from |

TABLE 1F-continued

| Zea mays L. Maize | | |
|---|---|---|
| Event | Company | Description |
| | Bred International Inc. | *Bacillus thuringiensis* strain PS149B1. The PAT encoding gene from *Streptomyces viridochromogenes* was introduced as a selectable marker. |
| DAS-59122-7 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) with NK603 (OECD unique identifier: MON-OO6O3-6). Corn rootworm-resistance is derived from DAS-59122-7 which contains the Cry34Ab1 and Cry35Ab1 genes from *Bacillus thuringiensis* strain PS149B1. Tolerance to glyphosate herbicide is derived from NK603. |
| DAS-59122-7 × TC1507 × NK603 | DOW AgroSciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-O15O7-1) with NK603 (OECD unique identifier: MON-OO6O3-6). Corn rootworm-resistance is derived from DAS-59122-7 which contains the Cry34Ab1 and Cry35Ab1 genes from *Bacillus thuringiensis* strain PS149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus* |
| DK404SR | BASF Inc. | Somaclonal variants with a modified acetyl-CoA-carboxylase (ACCase) were selected by culture of embryos on sethoxydim enriched medium. |
| Event 3272 | Syngenta Seeds, Inc. | Maize line expressing a heat stable alpha-amylase gene amy797E for use in the dry-grind ethanol process. The phosphomannose isomerase gene from *E. coli* was used as a selectable marker. |
| Event 98140 | Pioneer Hi-Bred International Inc. | Maize event expressing tolerance to glyphosate herbicide, via expression of a modified bacterial glyphosate N-acetlytransferase, and ALS-inhibiting herbicides, vial expression of a modified form of the maize acetolactate synthase enzyme. |
| EXP1910IT | Syngenta Seeds, Inc. (formerly Zeneca Seeds) | Tolerance to the imidazolinone herbicide, imazethapyr, induced by chemical mutagenesis of the acetolactate synthase (ALS) enzyme using ethyl methanesulfonate (EMS). |
| GA21 | Syngenta Seeds, Inc. (formerly Zeneca Seeds) | Introduction, by particle bombardment, of a modified 5-enolpyruvyl shikimate-3-phosphate synthase (EPSPS), an enzyme involved in the shikimate biochemical pathway for the production of the aromatic amino acids. |
| GA21 × MON810 | Monsanto Company | Stacked insect resistant and herbicide tolerant corn hybrid derived from conventional cross-breeding of the parental lines GA21 (OECD identifier: MON-OOO21-9) and MON810 (OECD identifier: MON-OO81O-6). |
| IT | Pioneer Hi-Bred International Inc. | Tolerance to the imidazolinone herbicide, imazethapyr, was obtained by in vitro selection of somaclonal variants. |
| LY038 | Monsanto Company | Altered amino acid composition, specifically elevated levels of lysine, through the introduction of the cordapA gene, derived from *Corynebacterium glutamicum*, encoding the enzyme dihydrodipicolinate synthase (cDHDPS). |
| MIR162 | Syngenta Seeds, Inc. | Insect-resistant maize event expressing a Vip3A protein from *Bacillus thuringiensis* and the *Escherichia coli* PMI selectable marker |
| MIR604 | Syngenta Seeds, Inc. | Corn rootworm resistant maize produced by transformation with a modified Cry3A gene. The phosphomannose isomerase gene from *E. coli* was used as a selectable marker. |
| MIR604 × GA21 | Syngenta Seeds, Inc. | Stacked insect resistant and herbicide tolerant maize produced by conventional cross breeding of parental lines MIR604 (OECD unique identifier: SYN-IR6O5-5) and GA21 (OECD unique identifier: MON-OOO21-9). Corn rootworm-resistance is derived from MIR604 which contains the mCry3A gene from *Bacillus thuringiensis*. Tolerance to glyphosate herbicide is derived from GA21. |
| MON80100 | Monsanto Company | Insect-resistant maize produced by inserting the Cry1Ab gene from *Bacillus thuringiensis* subsp. |

TABLE 1F-continued

| Zea mays L. Maize | | |
|---|---|---|
| Event | Company | Description |
| | | *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpyruvyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic modification affords resistance to attack by the European corn borer (ECB). |
| MON810 × LY038 | Monsanto Company | Stacked insect resistant and enhanced lysine content maize derived from conventional cross-breeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88O17-3). European corn borer (ECB) resistance is derived from a truncated form of the Cry1Ab gene from *Bacillus thuringiensis* subsp. *kurstaki* HD-1 present in MON810. Corn rootworm resistance is derived from the Cry3Bb1 gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bb1 gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-OO863-5) and MON810 (OECD identifier: MON-OO81O-6) |
| MON863 × MON810 × NK603 | Monsanto Company | Stacked insect resistant and herbicide tolerant corn hybrid derived from conventional cross-breeding of the stacked hybrid MON-OO863-5 × MON-OO81O-6 and NK603 (OECD identifier: MON-OO6O3-6). |
| MON863 × NK603 | Monsanto Company | Stacked insect resistant and herbicide tolerant corn hybrid derived from conventional cross-breeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Cry3Bb1 gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of Lepidopteran pests. |

TABLE 1F-continued

*Zea mays* L. Maize

| Event | Company | Description |
|---|---|---|
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89034-3) with NK603 (OECD unique identifier: MON-OO603-6). Resistance to Lepidopteran insects is derived from two Cry genes present in MON89043. Tolerance to glyphosate herbicide is derived from NK603. |
| MON89034 × TC1507 × MON88017 × DAS-59122-7 | Monsanto Company and Mycogen Seeds c/o Dow AgroSciences LLC | Stacked insect resistant and herbicide tolerant maize produced by conventional cross breeding of parental lines: MON89034, TC1507, MON88017, and DAS-59122. Resistance to the above-ground and below-ground insect pests and tolerance to glyphosate and glufosinate-ammonium containing herbicides. |
| MS3 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| MS6 | Bayer CropScience (Aventis CropScience(AgrEvo)) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × MON810 | Monsanto Company | Stacked insect resistant and herbicide tolerant corn hybrid derived from conventional cross-breeding of the parental lines NK603 (OECD identifier: MON-OO6O3-6) and MON810 (OECD identifier: MON-OO81O-6). |
| NK603 × T25 | Monsanto Company | Stacked glufosinate ammonium and glyphosate herbicide tolerant maize hybrid derived from conventional cross-breeding of the parental lines NK603 (OECD identifier: MON-OO6O3-6) and T25 (OECD identifier: ACS-ZM003-2). |
| T14, T25 | Bayer CropScience (Aventis CropScience(AgrEvo)) | Glufosinate herbicide tolerant maize produced by inserting the phosphinothricin N-acetyltransferase (PAT) encoding gene from the aerobic actinomycete *Streptomyces viridochromogenes*. |
| T25 × MON810 | Bayer CropScience (Aventis CropScience(AgrEvo)) | Stacked insect resistant and herbicide tolerant corn hybrid derived from conventional cross-breeding of the parental lines T25 (OECD identifier: ACS-ZMOO3-2) and MON810 (OECD identifier: MON-OO810-6). |
| TC1507 | Mycogen (c/o Dow AgroSciences); Pioneer (c/o DuPont) | Insect-resistant and glufosinate ammonium herbicide tolerant maize produced by inserting the Cry1F gene from *Bacillus thuringiensis* var. *aizawai* and the phosphinothricin N-acetyltransferase encoding gene from *Streptomyces viridochromogenes*. |
| TC1507 × DAS-59122-7 | DOW AgroSciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to Lepidopteran insects is derived from TC1507 due the presence of the Cry1F gene from *Bacillus thuringiensis* var. *aizawai*. Corn rootworm-resistance is derived from DAS-59122-7 which contains the Cry34Ab1 and Cry35Ab1 genes from *Bacillus thuringiensis* strain PS149B1. Tolerance to glufosinate ammonium herbicide is derived from TC1507 from the phosphinothricin N-acetyltransferase encoding gene from *Streptomyces viridochromogenes*. |
| TC1507 × NK603 | DOW AgroSciences LLC | Stacked insect resistant and herbicide tolerant corn hybrid derived from conventional cross-breeding of the parental lines 1507 (OECD identifier: DAS- |

TABLE 1F-continued

| Zea mays L. Maize | | |
|---|---|---|
| Event | Company | Description |
| | | O15O7-1) and NK603 (OECD identifier: MON-OO6O3-6). |

Other events with regulatory approval are well known to one skilled in the art and can be found at the Center for Environmental Risk Assessment (cera-gmc.org/?action=gm_crop_database, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the AfIP-1A polypeptides, AfIP-1B polypeptides, FGTW-51 (SEQ ID NO: 18), and FGTW-52 (SEQ ID NO: 20) or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et al., (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297:1833-1837; Jenuwein, (2002) *Science* 297:2215-2218 and Hall, et al., (2002) *Science* 297:2232-2237). As such, miRNA molecules of the invention can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the invention have an improved loading of RNAi into the phloem of the plant than would be observed with the expression of the silencing element construct alone and, thus provide better control of phloem feeding insects by an RNAi approach. In specific embodiments, the plants, plant parts and plant cells of the invention can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-

90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COP1 vesicle, the γ-coatomer of the COP1 vesicle, the β'-coatomer protein or the ζ-coatomer of the COP1 vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the AfIP-1A and/or AfIP-1B polypeptide, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*, fungi, particularly yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Pseudomonas chlororaphis, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Of particular interest are the pigmented microorganisms. Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens, P. chlororaphis*), *Erwinia* spp., and *Flavobacterium* spp., and other such organisms, including *Agrobacterium tumefaciens, E. coli, Bacillus subtilis, Bacillus cereus* and the like.

Genes encoding the AfIP-1A and/or AfIP-1B polypeptides of the embodiments can be introduced into microorganisms that multiply on plants (epiphytes) to deliver AfIP-1A and/or AfIP-1B polypeptides to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the AfIP-1A and/or AfIP-1B polypeptides of the embodiments can be introduced into a root-colonizing *Bacillus cereus* by standard methods known in the art.

Genes encoding AfIP-1A and/or AfIP-1B polypeptides can be introduced, for example, into the root-colonizing *Bacillus* by means of electro transformation. Specifically, genes encoding the AfIP-1A and/or AfIP-1B polypeptides can be cloned into a shuttle vector, for example, pHT3101 (Lerecius, et al., (1989) *FEMS Microbiol. Letts.* 60:211-218. The shuttle vector pHT3101 containing the coding sequence for the particular AfIP-1A and/or AfIP-1B polypeptide gene can, for example, be transformed into the root-colonizing *Bacillus* by means of electroporation (Lerecius, et al., (1989) *FEMS Microbiol. Letts.* 60:211-218).

Expression systems can be designed so that AfIP-1A and/or AfIP-1B polypeptides are secreted outside the cytoplasm of gram-negative bacteria, such as *E. coli*, for example. Advantages of having AfIP-1A and/or AfIP-1B polypeptides secreted are: (1) avoidance of potential cytotoxic effects of the AfIP-1A and/or AfIP-1B polypeptide expressed; and (2) improvement in the efficiency of purification of the AfIP-1A and/or AfIP-1B polypeptide, including, but not limited to, increased efficiency in the recovery and purification of the protein per volume cell broth and decreased time and/or costs of recovery and purification per unit protein.

AfIP-1A and/or AfIP-1B polypeptides can be made to be secreted in *E. coli*, for example, by fusing an appropriate *E. coli* signal peptide to the amino-terminal end of the AfIP-1A and/or AfIP-1B polypeptide. Signal peptides recognized by *E. coli* can be found in proteins already known to be secreted in *E. coli*, for example the OmpA protein (Ghrayeb, et al., (1984) *EMBO J,* 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud, et al., (1987) *Meth. Enzymol.* 153:492).

AfIP-1A and/or AfIP-1B polypeptides of the embodiments can be fermented in a bacterial host and the resulting bacteria processed and used as a microbial spray in the same manner that Bt strains have been used as insecticidal sprays. In the case of an AfIP-1A and/or AfIP-1B polypeptide(s) that is secreted from *Bacillus*, the secretion signal is removed or mutated using procedures known in the art. Such mutations and/or deletions prevent secretion of the AfIP-1A and/or AfIP-1B polypeptide(s) into the growth medium during the fermentation process. The AfIP-1A and/or AfIP-1B polypeptides are retained within the cell, and the cells are then processed to yield the encapsulated AfIP-1A and/or AfIP-1B polypeptides. Any suitable microorganism can be used for this purpose. *Pseudomonas* has been used to express Bt toxins as encapsulated proteins and the resulting cells processed and sprayed as an insecticide (Gaertner, et al., (1993), in: *Advanced Engineered Pesticides*, ed. Kim).

Alternatively, the AfIP-1A and/or AfIP-1B polypeptides are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated AfIP-1A and/or AfIP-1B polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible “baits” or fashioned into pest “traps” to permit feeding or ingestion by a target pest of the pesticidal formulation.

Methods of applying an active ingredient or an agrochemical composition that contains at least one of the AfIP-1A and/or AfIP-1B polypeptides produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. “Pesticidally-effective amount” as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, lndoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-)Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2

(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, lndoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* J E Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); Egira (Xylomyges) curialis Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other Archips species, *Adoxophyes orana* Fischer von Rösslerstamm (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermuller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Meneville (Chinese Oak Tussah Moth); *Bombyx mori* Linnaeus (Silkworm); *Bucculatrix thurberiella* Busck (cotton leaf perforator); *Collas eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria* lugubrosa Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); Phtyganidia californica Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenee (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); Tuta absolute Meyrick (tomato leafminer); *Yponomeuta padella* Linnaeus (ermine moth); *Heliothis* subflexa Guenee; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); *flea beetles*, cucumber beetles, rootworms, leaf beetles, potato beetles and leafminers in the family *Chrysomelidae* (including, but not limited to: *Leptinotarsa decemlineata* Say (Colorado potato beetle); *Diabrotica virgifera* virgifera LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (corn flea beetle); *Colaspis brunnea* Fabricius (grape *colaspis*); *Oulema melanopus* Linnaeus (cereal leaf beetle); *Zygogramma exclamationis* Fabricius (sunflower beetle)); *beetles from* the family Coccinellidae (including, but not limited to: *Epilachna varivestis* Mulsant (Mexican bean beetle)); *chafers and* other beetles from the family Scarabaeidae (including, but not limited to: *Popillia japonica* Newman (Japanese beetle); *Cyclocephala borealis* Arrow (northern masked chafer, white grub); *C. immaculate* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); *carpet beetles* from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to SEQ ID NO: 90, SEQ ID NO: 92, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and *Delphacidae*, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family *Coreidae* and red bugs and cotton stainers from the family *Pyrrhocoridae.*

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan phylloxera); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus* leucopterus Say (chinch bug); *Corythuca gossypii* Fabricius (cotton lace bug); *Cyrtopeltis modesta* Distant (tomato bug); *Dysdercus suturellus* Herrich-Schäffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; *Coreidae* spp.; *Pyrrhocoridae* spp.; Timidae spp.; *Blostomatidae* spp.; *Reduviidae* spp. and *Cimicidae* spp.

Also included are adults and larvae of the order Acari (mites) such as *Aceria* tosichella Keifer (wheat curl mite); *Petrobia latens* Müller (brown wheat mite); *spider mites* and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); *rust and* bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C.D.S. Tomlin Ed., Published by the British Crop Production Council, which is hereby incorporated by reference.

Some seed treatments that may be used on crop seed include, but are not limited to, one or more of abscisic acid, acibenzolar-5-methyl, avermectin, amitrol, azaconazole, azospirillum, azadirachtin, azoxystrobin, *Bacillus* spp. (including one or more of cereus, firmus, megaterium, pumilis, sphaericus, subtilis and/or thuringiensis species), *bradyrhizobium* spp. (including one or more of betae, canariense, elkanii, iriomotense, japonicum, liaonigense, pachyrhizi and/or yuanmingense), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, penicillium, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, trichoderma, trifloxystrobin, triticonazole and/or zinc. PCNB seed coat refers to EPA Registration Number 00293500419, containing quintozen and terrazole. TCMTB refers to 2-(thiocyanomethylthio)benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest, either simultaneously or sequentially, with an insecticidally-effective amount of a recombinant AfIP-1A and/or AfIP-1B polypeptide. In some embodiments methods are provided for killing an insect pest, comprising contacting the insect pest with an insecticidally-effective amount of a recombinant pesticidal protein of SEQ ID NO: 18 and/or protein of SEQ ID NO: 20 or a variant thereof.

In some embodiments methods are provided for controlling an insect pest population, comprising contacting the insect pest population, either simultaneously or sequentially, with an insecticidally-effective amount of a recombinant AfIP-1A and AfIP-1B polypeptides. In some embodiments methods are provided for controlling an insect pest population, comprising contacting the insect pest population with an insecticidally-effective amount of a recombinant pesticidal protein of SEQ ID NO: 18 and/or protein of SEQ ID NO: 20 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population, either simultaneously or sequentially, with an insecticidally-effective amount of a recombinant AfIP-1A and AfIP-1B polypeptide. In some embodiments methods are provided for controlling an insect pest population resistant to a pesticidal protein, comprising contacting the insect pest population with an insecticidally-effective amount of a recombinant pesticidal protein of SEQ ID NO: 18 and/or protein of SEQ ID NO: 20 or a variant thereof.

In some embodiments methods are provided for protecting a plant from an insect pest, comprising expressing in the plant or cell thereof a recombinant polynucleotide encoding an AfIP-1A and AfIP-1B polypeptide. In some embodiments methods are provided for protecting a plant from an insect pest, comprising expressing in the plant or cell thereof a recombinant polynucleotide encoding pesticidal protein of SEQ ID NO: 18 and/or protein of SEQ ID NO: 20 or variants thereof.

Cry3A Resistant WCRW Colony

Also provided is a Cry3A resistant laboratory-selected western corn rootworm (WCRW) colony with increased tolerance to a modified Cry3A (mCry3A) (U.S. Pat. No. 7,030,295) purified protein and maize events expressing high levels of mCry3A. In some embodiments the tolerance/resistance level of Cry3A-resistant WCRW colony to mCry3A was RR>90 based on LC50 values in diet based bioassays. The survival rate from larvae to adult on maize events expressing high levels of mCry3A was >60% relative to the isoline negative control treatments. A Cry3A resistant WCRW colony selected against the maize event (MIR604) with mCry3A expression level in roots (μg mCry3A/g dry weight) was 23.55-27.07 for MIR604-B and 16.29-21.18 for MIR604-C (US EPA 2010) has been reported (Meihls, L., et al., Journal of Economic Entomology 104:1045-1054 (2011). The MIR604 generated Cry3A-resistant WCRW colony has as a survival rate from larvae to adults of □40% relative to non-Bt isoline, which results in low tolerance/resistance level to mCry3A after 10 generations of selections (RR=15.4 based LC50).

In some embodiments methods are provided, using the Cry3A resistant WCRW colony of the present disclosure, for testing Cry3A resistance and Cry3A cross-resistance of insecticidal proteins, including but not limited to Cry proteins, and dsRNA molecules. In some embodiments methods are provided using the Cry3A resistant WCRW colony of the present disclosure for testing Cry3A resistance and Cry3A cross-resistance of the AfIP-1A polypeptides and AfIP-1B polypeptides of the present disclosure. In some embodiments methods are provided, using the Cry3A resistant WCRW colony of the present disclosure, to test for Cry3A resistance as part of an Insect Resistance Management (IRM) strategy.

In some embodiments methods are provided, using the Cry3A resistant WCRW colony of the present disclosure, for screening for Cry3A cross-resistance of insecticidal proteins. In some embodiments methods are provided, using the Cry3A resistant WCRW colony of the present disclosure, for screening AfIP-1A polypeptides and AfIP-1B polypeptides for Cry3A cross-resistance.

In some embodiments methods are provided, using molecular markers based on transcriptome analyses, for detection of the Cry3A-Resistant insects.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the AfIP-1A and AfIP-1B polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management the at least one of the insecticidal proteins comprise an AfIP-1A and AfIP-1B polypeptide insecticidal to insects in the order Lepidoptera and/or Coleoptera.

In some embodiments the methods of controlling Lepidoptera and/or Coleoptera insect infestation in a transgenic plant and promoting insect resistance management the at least one of the insecticidal proteins comprises a protein of SEQ ID NO: 18 and/or protein of SEQ ID NO: 20 or variants thereof, insecticidal to insects in the order Lepidoptera and/or Coleoptera.

In some embodiments the methods of controlling Lepidoptera and/or Coleoptera insect infestation in a transgenic plant and promoting insect resistance management comprise expressing in the transgenic plant an AfIP-1A and AfIP-1B polypeptide and a Cry protein insecticidal to insects in the order Lepidoptera and/or Coleoptera having different modes of action.

In some embodiments the methods of controlling Lepidoptera and/or Coleoptera insect infestation in a transgenic plant and promoting insect resistance management comprise in the transgenic plant a protein of SEQ ID NO: 18 and/or protein of SEQ ID NO: 20 or variants thereof and a Cry protein insecticidal to insects in the order Lepidoptera and/or Coleoptera having different modes of action.

Also provided are methods of reducing likelihood of emergence of Lepidoptera and/or Coleoptera insect resistance to transgenic plants expressing in the plants insecticidal proteins to control the insect species, comprising expression of an AfIP-1A and AfIP-1B polypeptide insecticidal to the insect species in combination with a second insecticidal protein to the insect species having different modes of action.

Also provided are methods of reducing likelihood of emergence of Lepidoptera and/or Coleoptera insect resistance to transgenic plants expressing in the plants insecticidal proteins to control the insect species, comprising expression of a protein of SEQ ID NO: 18 and/or protein of SEQ ID NO: 20 or variants thereof, insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an AfIP-1A and AfIP-1B polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a protein of SEQ ID NO: 18 and/or protein of SEQ ID NO: 20 or variants thereof and a Cry protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the AfIP-1A and AfIP-1B polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the protein of SEQ ID NO: 18 and/or protein of SEQ ID NO: 20 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing an AfIP-1A and AfIP-1B polypeptide disclosed herein. Expression of the AfIP-1A and AfIP-1B polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising an AfIP-1A polypeptide and/or AfIP-1B polypeptide. The plants, plant parts or seeds provided herein, can be processed to yield oil, protein products and/or by-products that are derivatives obtained by processing that have commercial value. Non-limiting examples include transgenic seeds comprising a nucleic acid molecule encoding an AfIP-1A polypeptide and/or AfIP-1B polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1

Identification of an Insecticidal Protein Active Against Western Corn Rootworm from Strain DDMC P4G7

The insecticidal proteins AfIP-1A-31 and AfIP-1B-32 were identified by protein purification, N-terminal amino acid sequencing, and PCR cloning from bacterial strain DDMC P4G7 as follows. Insecticidal activity against western corn rootworm (*Diabrotica virgifera virgifera*, WCRW) was observed from a cell lysate of DDMC P4G7 grown in Luria Broth (LB) and cultured overnight at 28° C.

Western corn rootworm (WCRW) bioassays were conducted using the cell lysate samples mixed with molten low-melt WCRW diet (Southland Products Inc., Lake Village, Ark.) in a 96 well format. *Diabrotica virgifera* virgifera neonates were placed into each well of a 96 well plate. The assay was run four days at 25° C. and then was scored for insect mortality and stunting of insect growth. The scores were noted as dead, severely stunted (little or no growth but alive), stunted (growth to second instar but not equivalent to controls) or no activity. Samples demonstrating mortality or severe stunting were further studied.

Genomic DNA was extracted using the GenElute™ Bacterial Genomic DNA kit (Sigma). The 16S ribosomal sequences were generated by polymerase chain reaction using the HF advantage PCR kit (Clontech) and the 16S conserved PCR primers AGAGTTTGATCCTGGCTCAG (16SFOR) (SEQ ID NO: 7) and ACGGCTACCTTGTTACGACTT (16SREV) (SEQ ID NO: 8)). The DNA products of this reaction were end-sequenced in 96-well plates using the ABI BigDye™ terminator version 3.1 Prism sequencing kit. After ethanol-based cleanup, cycle sequencing reaction products were resolved and detected on a Life Technologies™ ABI 3730×1 automated sequencer and individual sequences were retrieved from the sequencer. The 16s rRNA gene sequence was used as the query sequence for a FastA search (Wisconsin Package Version 9.0, Genetics Computer Group, Madison, Wis.) of GenBank for similar sequences. Based on the rRNA gene sequence, the strain was identified as an *Alcaligenes faecalis*. The *Alcaligenes faecalis* strain DDMC P4G7 was deposited on Jan. 3, 2012 under accession #NRRL B-50625 with the Agricultural Research Service Culture Collection (NRRL), 1815 North University Street, Peoria, Ill. 61604, (nrrl.ncaur.usda.gov, which can be accessed on the world-wide web using the "www" prefix).

The cell pellet of an overnight culture from a single colony of DDMC P4G7 was lysed using two passes in a TS-series cell disruptor (Constant Systems Inc.). The clarified extract was fractionated with 40% ammonium sulfate and the precipitated protein was removed by centrifugation. The ammonium sulfate concentration was raised to 80% saturation the precipitated protein was removed by centrifugation. The pellet fraction was dissolved in 20 mM Na MOPS pH 7.1, 10 mM NaCl, centrifuged, and desalted into 20 mM MOPS pH 7.1, 10 mM NaCl using a GE HiPrep 26/10 desalting column. The desalted extract was loaded onto a 20 mL Ceramic HyperD® Q anion exchange column (Pall) of appropriate size. A linear 7.5 column volume gradient was run from 0 to 300 mM NaCl. Fractions of the Ceramic HyperD® Q anion exchange column were tested against WCRW in a pesticidal bioassay described above. The WCRW-active Hyper D pool was concentrated, desalted and loaded onto a 22 mL hydroxyl apatite column (Type 1

Hydroxy Apatite Bio-Rad) and a 15 bed volume gradient was run from 0 to 150 mM sodium phosphate pH 6.8. The WCRW-active fractions were concentrated with 10 kDa spin filters and loaded onto a Superdex® 200 column equilibrated in 100 mM ammonium bicarbonate. Fractions obtained following Superdex® 200 chromatography were again assayed for WCRW activity. At this stage, mixing of two components or fractions was found to be required to maintain high level activity against WCRW indicating that more than one protein may be required. Each of the identified WCRW-active component pools were loaded onto a 0.8 mL ProSwift® SAX column (Dionex) and a 60 column volume gradient was started from 0 to 220 mM NaCl, pH6.2. Fractions were once again assayed for activity against WCRW in the presence or absence of a second component. The WCRW-active components were further purified resulting in single bands on LDS electrophoresis gels. The larger component, designated herein as AfIP-1B-32 was predicted to be approximately 76 kDa and the smaller component, designated herein as AfIP-1A-31 was predicted to be approximately 16 kDa. The individual components showed insecticidal activity only at higher concentrations when evaluated individually but combination of AfIP-1A-31 with AfIP-1B-32 inhibited growth of WCRW larvae at concentrations ~100 fold less.

To determine the AfIP-1A-31 and AfIP-1B-32 protein sequence, N-terminal sequencing and mass spectrometry were conducted. The portion of the LDS gel corresponding to the 76 KDa and 16 KDa bands was destained and excised and submitted for both N-terminal sequencing and MS identification. Digested proteins for MS identification were prepared with de-stained excised gel bands. The excised gel bands were reduced with DTT and then alkylated with iodoacetamide. Following overnight digestion with trypsin, the samples were submitted for LCMS analysis.

Liquid chromatography-tandem mass spectrometry (LC-MS/MSMS) analysis for tryptically-digested peptides was conducted using electrospray on a LTQ Orbitrap XL™ mass spectrometer (Thermo Scientific, San Jose, Calif.) coupled with an Eksigent NanoLC-1D Plus™ nano-LC system (Eksigent, Dublin, Calif.).

Amino acid sequences were determined for the N-terminal portions of AfIP-1A-31 and AfIP-1B-32. The proteins of interest were blotted to a PVDF membrane and inserted into a Procise cartridge to be subjected to chemical conversion to PTH (phenylthiohydantoin) amino acids on an Applied Biosystems® Procise® 494 Protein Sequencer (Applied Biosystems®, California).

The resulting N-terminal amino acid sequence was BLAST searched against an in-house database (Bacteria-Plus) that included all bacterial protein sequences and keratin sequences from NCBI non-redundant database (nr) and in-house protein sequences. A small nucleotide sequences search database was made with contigs generated from the genomic sequence of *Alcaligenes faecalis* strain DDMC P4G7. The contigs generated for this strain are described in Example 2. The DDMC P4G7 contigs were also translated to open reading frame proteins (ORFs) using EMBOSS getorf software.

Example 2

Genomic Sequencing of AfIP-1A-31 and AfIP-1B-32

Isolated *Alcaligenes faecalis* strain DDMC P4G7 genomic DNA was prepared according to a library construction protocol developed by Illumina® and sequenced using the Illumina® Genome Analyzer IIx. The nucleic acid contig sequences were assembled and open reading frames were generated.

Amino acid sequence stretches identified for AfIP-1A-31 and AfIP-1B-32 by N-terminal sequencing and LC-MS/MS/MS sequencing (described in Example 1) were searched against the proteins predicted by open reading frames (ORFs) of the contig assemblies. The peptides gave perfect matches to two adjacent ORFs called ORF101 and ORF105 corresponding to AfIP-1A-31 and AfIP-1B-32, respectively. ORF101 and ORF105 were reading in the same direction and separated by 11 base pairs. Upstream of ORF101 the next ORF (265) read in the opposite direction. Downstream ORF105 there were 3 ORFs reading also in the opposite direction. It appears that ORFs 101 and 105 encode AfIP-1A-31 and AfIP-1B-32 and form a single operon.

The coding sequences were used to design the following primers to clone the AfIP-1A-31 coding sequence: GCTGAGGACTTACATATGACTGC (Orf101FOR) (SEQ ID NO: 9) and CTTCTATGTCCAGGATCCTCTCCCTTAGG (Orf101REV) (SEQ ID NO: 10). This clone was produced by polymerase chain reaction using the HF Advantage® PCR kit (Clontech) and the genomic DNA from DDMC P4G7 as a template. The DNA produced was ligated into pET-14a (Novagen®) using the NdeI/XhoI sites. The cloned sequence was confirmed by sequencing.

The coding sequence was used to design the following primers to clone the AfIP-1B-32 gene: GGAGAAACATATGGACATAGAAGCTAAATCC (Orf105FOR) (SEQ ID NO: 11) and GGAGGATCCCTGAGTTTCAGGCC (Orf105REV) (SEQ ID NO: 12). The touchdown PCR assay conditions (GenomeWalker™ Universal Kit (BD Biosciences) were used with the Advantage®-HF PCR kit. The DNA produced was ligated into pET-14a (Novagen®) using the NdeI/XhoI sites. The clone sequence was confirmed by sequencing.

Based on the DNA and protein sequencing, the AfIP-1A-31 polynucleotide sequence is shown as SEQ ID NO: 1 and the polypeptide sequence as SEQ ID NO: 2. The AfIP-1B-32 polynucleotide sequence is provided as SEQ ID NO: 3 and the polypeptide sequence as SEQ ID NO: 4. An N-terminally truncated (4 amino acids) AfIP-1A-31 polypeptide was also identified from *Alcaligenes faecalis* strain DDMC P4G7, which is provided as SEQ ID NO: 6 and was found to have WCRW insecticidal activity when combined with AfIP-1B-32 protein (SEQ ID NO: 4). The polynucleotide sequence having an ATG codon (SEQ ID NO:5) encoding the 4 N-terminal amino acid truncated AfIP-1A-31 with Met added at the N-terminus (SEQ ID NO: 6) was synthesized and expressed in *E. coli* confirming the WCRW insecticidal activity when combined with AfIP-1B-32 protein (SEQ ID NO: 4).

Example 3

AfIP-1A-31 and AfIP-1B-32 Genomic Sequence & Homology Analysis

Gene identities may be determined by conducting BLAST (Basic Local Alignment Search Tool; Altschul, et al., (1993) *J. Mol. Biol.* 215:403-410; see also ncbi.nlm.nih.gov/BLAST/, which can be accessed using the www prefix) searches under default parameters for similarity to sequences contained in the publically available BLAST "nr" database (comprising all non-redundant GenBank CDS translations, sequences derived from the 3-dimensional structure Brookhaven Protein Data Bank, the last major release of the SWISS-PROT protein sequence database, EMBL, and DDBJ databases). The polynucleotide sequences SEQ ID NO: 1 and SEQ ID NO: 3 were analyzed.

AfIP-1A-31 (SEQ ID NO: 2) showed distant homology to aegerolysin-like proteins which have a Pfam ID#PF06355 (Reference to Pfam database: en.wikipedia.org/wiki/Pfam, which can be accessed using the www prefix). No close homologs of AfIP-1B-32 (SEQ ID NO: 3) were identified. Distant homologs, hypothetical protein Slin_6118 (NCBI Reference Sequence: YP_003390879.1) and hypothetical protein Slin_6117 (NCBI Reference Sequence: YP_003390878.1) were identified from *Spirosoma linguale* (designated herein as Slin6118 and Slin6117). The *Spirosoma linguale* coding sequence has a DNA sequences set forth in SEQ ID NO: 13 and an amino acid sequence designated as Slin6118 is set forth in SEQ ID NO: 14. The amino acid sequence of Slin6118 (SEQ ID NO: 14) shows 43% identity and 61% similarity to AfIP-1A-31 (SEQ ID NO: 2). The Slin6117 DNA sequence is set forth as SEQ ID NO: 15 and the amino acid as SEQ ID NO: 16. The amino acid sequence of Slin6117 (SEQ ID NO: 16) shows 36% identity and 60% similarity to AfIP-1B-32 (SEQ ID NO: 2).

A search of DOE-JGI metagenomic sequence databases (img.jgi.doe.gov/cgi-bin/m/main.cgi, which can be accessed using the www prefix) for nucleic acid sequences encoding proteins belonging to Pfam Pf06355 led to the identification of FGTW-51 from sequences associated with Fungus-growing Termite Worker (FGTW) sequences. The hypothetical gene ID#2066809079 on FGTW_contig30527 (SEQ ID NO:17) encoded a predicted aegerolysin-like protein designated herein as FGTW-51 (SEQ ID NO: 18). The predicted FGTW-51 amino acid sequence (SEQ ID NO: 18) shows 46% identity and 61% similarity to AfIP-1A-31 (SEQ ID NO: 2). 152 nucleotides downstream of the FGTW-51 gene was the hypothetical gene ID#2066809078 (SEQ ID NO: 19) encoding a hypothetical protein designated herein as FGTW-52 (SEQ ID NO: 20), which shows 48% identity and 69% similarity to AfIP-1B-32 (SEQ ID NO: 4). FIG. 1 shows an alignment of the amino acid sequences of AfIP-1A-31 (SEQ ID NO: 2) with Slin6118 (SEQ ID NO: 14) and FGTW-51 (SEQ ID NO: 18). FIG. 2 shows an alignment of the amino acid sequences of AfIP-1B-32 (SEQ ID NO: 4) with Slin6117 (SEQ ID NO: 16) and FGTW-52 (SEQ ID NO: 20). Moreover, tables summarizing the global identity and similarity data (in parenthesis) are presented in Table 1A and Table 1B. Percent identity and similarity values were calculated using ClustalW algorithm in the ALIGNX® module of the Vector NTI® Program Suite (Invitrogen™ Corporation, Carlsbad, Calif.) with all default parameters.

TABLE 1A

| | Slin6118 | FGTW-51 |
|---|---|---|
| AfIP-1A-31 | 38.5% (50%) | 43.8% (51.4%) |
| Slin6118 | | 40.8% (54.2%) |

TABLE 1B

| | Slin6117 | FGTW-52 |
|---|---|---|
| AfIP-1B-32 | 35% (51.7%) | 47.1% (60.7%) |
| Slin6117 | | 37.9% (53.3%) |

Example 4

*E. coli* Expression of AfIP-1A-31 and AfIP-1B-32 Recombinant Proteins

The AfIP-1A-31 and AfIP-1B-32 coding sequences were synthesized and cloned into a pET24 vector (Novagen®) both with the native stop codon (TAA), SEQ ID NO: 1 and SEQ ID NO: 2 respectively, and with the stop codon removed for C-terminal translation of a 6×-histidine tag addition and the sequences of the histidine-tagged AfIP-1A-31 is set forth as SEQ ID NO: 23 and histidine-tagged AfIP-1B-32 is set forth as SEQ ID NO: 25. These four vectors were transformed into *E. coli* cells. Large scale cultures were grown until O.D.280 nm~0.5 and then the cultures were induced with isopropyl β-D-1-thiogalactopyranoside (IPTG) and allowed to grow for 16 hours at 16° C. The cell pellets were lysed with ¼ B-PER reagent (ThermoScientific), 50 mM Tris pH 8.0, and OmniCleave™ endonuclease and Ready-Lyse™ lysozyme (Epicentre®). After lysis, the solutions were centrifuged and the supernatant from the pET24 AfIP-1A-31 and pET24 AfIP-1B-32 native stop codon construct cultures were pelleted with 30% ammonium sulfate, spun and the supernatant was pelleted with 80% ammonium sulfate. Lysates submitted for WCRW assay were active. The same procedure was followed for the pET24 AfIP-1A-31 and AfIP-1B-32 constructs with the C-terminal 6×-histidine tag except the lysate were further purified over a Talon™ resin column (ThermoScientific). The His-tagged protein was eluted with 150 mM imidazole in PBS. The imidazole was removed from the sample using a PD-10 desalting column (GE Healthcare) equilibrated in PBS. Lysates submitted for WCRW assay were active when both AfIP-1A-31 (SEQ ID NO: 2 or SEQ ID NO: 24 (His-tagged)) and AfIP-1B-32 (SEQ ID NO: 4 or SEQ ID NO: 26 (His-tagged)) were present.

Example 5

Coleoptera Assays with Purified Proteins

Insecticidal activity bioassay screens were conducted with purified recombinant C-terminally His-tagged AfIP-1A-31 (SEQ ID NO: 24) and C-terminally His-tagged AfIP-1B-32 (SEQ ID NO: 26) to evaluate the insecticidal protein effects on larvae of a variety of Coleoptera including Western corn rootworm (*Diabrotica virgifera*)—WCRW, Southern corn rootworm (*Diabrotica undecimpunctata howardi*)—SCRW, Northern corn rootworm (*Diabrotica barberi*)—NCRW, Coleoptera feeding assays were conducted on an artificial diet containing the insecticidal protein. The insecticidal proteins were incorporated into a Coleopteran-specific artificial diet (Southland Products Inc., Lake Village, Ark.). One neonate larva was placed in each well to feed ad libitum for 4 days. Results were expressed as positive for larvae reactions such as stunting and or mortality. Results were expressed as negative if the larvae were similar to the negative control that was fed a diet to which the above buffer only was applied. To determine an $LC_{50}$ and $IC_{50}$ of the AfIP-1A-31 (His-tagged SEQ ID NO: 24) and AfIP-1B-32 (His-tagged SEQ ID NO: 26) insecticidal polypeptides, on Western corn rootworm (*Diabrotica virgifera*) AfIP-1A-31 was assayed in a dilution series from 250 ppm to 0.1 ppm while AfIP-1B-32 was kept at 250 ppm and conversely AfIP-1B-32 was assayed in a dilution series from 250 ppm to 0.1 ppm while AfIP-1A-31 was kept at 250 ppm. One neonate larva was placed in each well to feed ad libitum for 4 days. Each bioassay was done with eight duplicates at each dose and the bioassay was replicated three times. Results are expressed as $LC_{50}$ for mortality and/or $IC_{50}$ by weighing the surviving larvae at each protein concentration. The results of the WCRW assays for the insecticidal polypeptides AfIP-1A-31 (SEQ ID NO: 2) and AfIP-1B-32 (SEQ ID NO: 4) dilution of one component while second component kept at 250 ppm are shown in Table 2.

TABLE 2

WCRW assay of AfIP-1A-31 and AfIP-1B-32

| Protein | $LC_{50}$, ppm (95% confidence interval) | Neg. Check |
|---|---|---|
| AfIP-1A-31 (+ AfIP-1B-32 @ 250 ppm) | 1.151 (0.7029-1.794) | AfIP-1B-32 @ 250 ppm |
| AfIP-1B-32 (+ AfIP-1A-31 @ 250 ppm) | 1.158 (0.663-1.916) | AfIP-1A-31 @ 250 ppm |

AfIP-1A-31 (SEQ ID NO: 2) and AfIP-1B-32 (SEQ ID NO: 4) at equal mass ratio are shown in Table 3.

TABLE 3

| Insect | LC/IC | ppm | Insect | LC/IC | ppm |
|---|---|---|---|---|---|
| SCRW | $LC_{50}$ | 397.7 | NCRW | $LC_{50}$ | 11.11 |
| | $IC_{50}$ | 77.98 | | $IC_{50}$ | 4.609 |
| WCRW | $LC_{50}$ | 26.30 | WCRW | $LC_{50}$ | 30.11 |
| | $IC_{50}$ | 7.947 | | $IC_{50}$ | 10.81 |

To further explore the insecticidal activity of AfIP-1A-31 and AfIP-1B-32 the WCRW assay was conducted at different concentration ratios (Table 4) using a dilution matrix for each protein between 128 ppm and 0.06 ppm (7951 nM to 3.7 nM for AfIP-1A-31 and 1671 nM to 0.8 nM for AfIP-1B-32). Each dilution combination was scored for killing or stunting. Severe stunting activity was observed down to ~1 ppm for each component and severe stunting was observed below 0.1 ppm when the second component was saturating (Table 4).

TABLE 4

| Incorporated WCRW assay score | | | | [AfIP-1A-31] PPM | | | | | | | | | | | |
|---|---|---|---|---|---|---|---|---|---|---|---|---|---|---|---|
| | | | | 128 | 64 | 32 | 16 | 8 | 4 | 2 | 1 | 0.5 | 0.25 | 0.13 | 0.06 |
| | | | | [AfIP-1A-31] nM | | | | | | | | | | | |
| | | | | 7950.8 | 3975.4 | 1987.7 | 993.9 | 496.9 | 248.5 | 124.2 | 62.1 | 31.1 | 15.5 | 8.1 | 3.7 |
| [AfIP-1B-32] PPM | 128 | [AfIP-1B-32] nM | 1671.4 | 2.7 | 2.8 | 2.7 | 2.7 | 2.3 | 2.3 | 2.2 | 2.3 | 2.2 | 2.5 | 2.2 | 1.8 |
| | 64 | | 835.7 | 2.3 | 2.5 | 2.7 | 2.5 | 2.0 | 2.3 | 2.2 | 2.0 | 1.8 | 2.2 | 1.8 | 1.6 |
| | 32 | | 417.9 | 2.3 | 2.8 | 2.8 | 2.5 | 2.3 | 2.3 | 2.2 | 2.2 | 2.0 | 2.2 | 1.8 | 1.0 |
| | 16 | | 208.9 | 2.3 | 2.5 | 2.0 | 2.5 | 2.3 | 2.0 | 2.2 | 2.3 | 2.0 | 2.0 | 0.8 | 1.2 |
| | 8 | | 104.5 | 2.3 | 2.8 | 2.5 | 2.0 | 2.0 | 1.8 | 2.0 | 1.8 | 1.7 | 1.8 | 1.3 | 0.6 |
| | 4 | | 52.2 | 2.5 | 2.2 | 2.2 | 2.2 | 2.2 | 1.8 | 1.8 | 1.5 | 1.3 | 1.5 | 1.3 | 0.3 |
| | 2 | | 26.1 | 2.7 | 2.7 | 2.2 | 2.3 | 2.2 | 2.0 | 2.2 | 1.8 | 1.3 | 1.7 | 1.5 | 0.5 |
| | 1 | | 13.1 | 2.2 | 2.2 | 2.2 | 2.0 | 2.5 | 1.7 | 2.0 | 1.8 | 1.3 | 1.5 | 0.5 | 0.2 |
| | 0.5 | | 6.5 | 2.2 | 2.3 | 2.3 | 2.0 | 2.0 | 1.7 | 1.5 | 1.7 | 1.5 | 1.2 | 0.5 | 0.2 |
| | 0.25 | | 3.3 | 2.3 | 2.3 | 2.0 | 2.0 | 1.8 | 1.7 | 2.0 | 1.8 | 1.2 | 0.8 | 0.2 | 0.2 |
| | 0.13 | | 1.7 | 2.0 | 2.3 | 2.0 | 2.0 | 2.0 | 1.8 | 2.0 | 2.0 | 0.8 | 1.0 | 0.2 | 0.2 |
| | 0.06 | | 0.8 | 2.0 | 1.8 | 2.0 | 1.8 | 1.5 | 1.2 | 1.5 | 1.0 | 1.2 | 1.0 | 0.3 | 0.2 |

In addition, $IC_{50}$ and $LC_{50}$ was also determined with AfIP-1A-31 and AfIP-1B-32 at an equal mass ratio and serially diluted two fold from 240 ppm AfIP-1A-31 plus 240 ppm AfIP-1B-32 with PBS and with insect diet for each protein for Western corn rootworm (*Diabrotica virgifera*)—WCRW, Southern corn rootworm (*Diabrotica undecimpunctata howardi*)—SCRW, Northern corn rootworm (*Diabrotica barberi*)—NCRW. The results of the WCRW, NCRW, and SCRW assays for the insecticidal polypeptides To further explore the insecticidal activity of AfIP-1A-31 and AfIP-1B-32 individually the WCRW assay was conducted at different concentrations using a dilution matrix for each protein between 10,000 ppm and 156 ppm (protein conc. of stock solution determined by BCA) for AfIP-1A-31 and 6000 ppm to 94 ppm (protein conc. of stock solution determined by BCA) for AfIP-1B-32. Each dilution was scored for killing or stunting. Stunting was consistently observed at or above 625 ppm for AfIP-1A-31 alone and at or above 3000 ppm for AfIP-1B-32 alone (Table 5).

TABLE 5

| | | | | WCRW | | | | | | | | |
|---|---|---|---|---|---|---|---|---|---|---|---|---|
| Comp. A | PPM | Comp B. | PPM | Rep 1 | Rep 2 | Rep 3 | Rep 4 | Rep 6 | Rep 6 | Rep 7 | Rep 8 | Ave |
| PBS | | | | 0 | 0 | 0 | 0 | 0 | 0 | 0 | 0 | 0 |
| AfIP-1A-31 | 10,000 | | | 3 | 2 | 3 | 2 | 2 | 3 | 2 | 2 | 2.375 |
| AfIP-1A-31 | 5,000 | | | 2 | 2 | 2 | 2 | 2 | 2 | 2 | 2 | 2 |
| AfIP-1A-31 | 2,500 | | | 2 | 2 | 2 | 2 | 2 | 2 | 2 | 2 | 2 |
| AfIP-1A-31 | 1,250 | | | 2 | 2 | 1 | 1 | 1 | 2 | 3 | 1 | 1.625 |
| AfIP-1A-31 | 625 | | | 1 | 3 | 2 | 3 | 1 | 1 | 1 | 1 | 1.625 |
| AfIP-1A-31 | 313 | | | 1 | 0 | 0 | 1 | 1 | 1 | 1 | 1 | 0.75 |
| AfIP-1A-31 | 156 | | | 0 | 0 | 0 | 0 | 0 | 0 | 0 | 0 | 0 |
| AfIP-1A-31 | 78 | AfIP-1B-32 | 47 | 3 | 3 | 2 | 2 | 3 | 2 | 3 | 3 | 2.625 |
| AfIP-1A-31 | 39 | AfIP-1B-32 | 23 | 2 | 2 | 2 | 2 | 3 | 2 | 3 | 3 | 2.375 |

TABLE 5-continued

| Comp. A | PPM | Comp B. | PPM | WCRW Rep 1 | Rep 2 | Rep 3 | Rep 4 | Rep 6 | Rep 6 | Rep 7 | Rep 8 | Ave |
|---|---|---|---|---|---|---|---|---|---|---|---|---|
| AfIP-1A-31 | 20 | AfIP-1B-32 | 12 | 2 | 2 | 2 | 2 | 2 | 2 | 2 | 2 | 2 |
| PBS | | | | 0 | 0 | 0 | 0 | 0 | 0 | 0 | 0 | 0 |
| PBS | | | | 0 | 0 | 0 | 0 | 0 | 0 | 0 | 0 | 0 |
| | | AfIP-1B-32 | 6000 | 2 | 2 | 2 | 2 | 2 | 2 | 2 | 3 | 2.125 |
| | | AfIP-1B-32 | 3000 | 2 | 3 | 1 | 1 | 2 | 1 | 2 | 1 | 1.625 |
| | | AfIP-1B-32 | 1500 | 2 | 0 | 0 | 1 | 0 | 1 | 0 | 1 | 0.625 |
| | | AfIP-1B-32 | 750 | 0 | 0 | 0 | 0 | 0 | 0 | 0 | 0 | 0 |
| | | AfIP-1B-32 | 375 | 0 | 0 | 0 | 0 | 0 | 0 | 0 | 0 | 0 |
| | | AfIP-1B-32 | 188 | 0 | 0 | 0 | 0 | 0 | 0 | 0 | 0 | 0 |
| | | AfIP-1B-32 | 94 | 0 | 0 | 0 | 0 | 0 | 0 | 0 | 0 | 0 |
| 2X PBS | | | | 0 | 0 | 0 | 0 | 0 | 0 | 0 | 0 | 0 |
| 1.5X PBS | | | | 0 | 0 | 0 | 0 | 0 | 0 | 0 | 0 | 0 |
| 1.25X PBS | | | | 0 | 0 | 0 | 0 | 0 | 0 | 0 | 0 | 0 |
| PBS | | | | 0 | 0 | 0 | 0 | 0 | 0 | 0 | 0 | 0 |

Example 6

Lepidoptera Assays with Purified Proteins

Insecticidal activity bioassay screens were conducted with purified recombinant C-terminally His-tagged AfIP-1A-31 (SEQ ID NO: 24) and C-terminally His-tagged AfIP-1B-32 (SEQ ID NO: 26) to evaluate the insecticidal protein effects on larvae of a variety of Lepidoptera.

Lepidoptera feeding assays were conducted on an artificial diet containing AfIP-1A-31 (SEQ ID NO: 24) and AfIP-1B-32 (SEQ ID NO: 26) proteins at equal mass ratio in PBS. The proteins were topically applied to a Lepidopteran-specific artificial diet (Southland Products) the wells at a rate of 0, 31.25 ppm, 62.5 ppm, 125 ppm, 250 ppm, 500 ppm and 1000 ppm and allowed to dry. The AfIP-1A-31 and AfIP-1B-32 insecticidal polypeptides were tested for activity against soybean looper (SBL, *Pseudoplusia includens*), velvet bean caterpillar (VBC, *Anticarsia gemmatalis*) European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*). 2-3 neonate larvae were placed in each well to feed ad libitum for 3 days. Each bioassay was done with 4 duplicates at each dose. Results were expressed as positive for larvae reactions such as stunting and or mortality. Results were expressed as negative if the larvae were similar to the negative control that was fed diet to which the above buffer only has been applied. Larvae that had a size similar to controls were assigned a score of 0, those that showed slight stunting were scored 1, those that showed severe stunting were scored 2 and those that were dead were scored 3. Similar AfIP-1A-31 (His-tagged SEQ ID NO: 24) and AfIP-1B-32 (His-tagged SEQ ID NO: 26) combined did not show insecticidal activity at the concentrations tested against European corn borer (ECB, *Ostrinia nubilalis*), corn earworm (CEW, *Helicoverpa zea*), fall army worm (FAW, *Spodoptera frugiperda*) and black cutworm (BCW, *Agrotis ipsilon*). The insecticidal activity of AfIP-1A-31 (His-tagged SEQ ID NO: 24) and AfIP-1B-32 (His-tagged SEQ ID NO: 26) combined in the soybean looper (SBL, *Pseudoplusia includens*) and velvet bean caterpillar (VBC, *Anticarsia gemmatalis*) is shown in Table 6.

TABLE 6

| Sample | SBL Rep 1 | SBL Rep 2 | SBL Rep 3 | SBL Rep 4 | SBL Ave |
|---|---|---|---|---|---|
| 1000 PPM AfIP-1A-31 & AfIP-1B-32 | | 3 | 3 | 3 | 3.0 |
| 500 PPM AfIP-1A-31 & AfIP-1B-32 | 3 | 3 | 3 | 3 | 3.0 |
| 250 PPM AfIP-1A-31 & AfIP-1B-32 | 3 | 3 | 3 | 2 | 2.8 |
| 125 PPM AfIP-1A-31 & AfIP-1B-32 | 3 | 2 | 3 | 3 | 2.8 |
| 62.5 PPM AfIP-1A-31 & AfIP-1B-32 | 0 | 3 | 3 | 0 | 1.5 |
| 31.25 PPM AfIP-1A-31 & AfIP-1B-32 | 0 | 0 | 0 | 0 | 0.0 |
| PBS | 0 | 0 | 0 | 0 | 0.0 |
| PBS | | 0 | 0 | 0 | 0.0 |

| Sample | VBC Rep 1 | VBC Rep 2 | VBC Rep 3 | VBC Rep 4 | VBC Ave |
|---|---|---|---|---|---|
| 1000 PPM AfIP-1A-31 & AfIP-1B-32 | 0 | 3 | 3 | 3 | 2.3 |
| 500 PPM AfIP-1A-31 & AfIP-1B-32 | 3 | 2 | 1 | 2 | 2.0 |
| 250 PPM AfIP-1A-31 & AfIP-1B-3 | 2 | 3 | 1 | 2 | 2.0 |
| 125 PPM AfIP-1A-31 & AfIP-1B-32 | 2 | 3 | 2 | 1 | 2.0 |
| 62.5 PPM AfIP-1A-31 & AfIP-1B-32 | 0 | 0 | 0 | 1 | 0.3 |
| 31.25 PPM AfIP-1A-31 & AfIP-1B-32 | 1 | 1 | 1 | 1 | 1.0 |
| PBS | 0 | 0 | 0 | 0 | 0.0 |
| PBS | 0 | 1 | 0 | 0 | 0.3 |

Example 7

Identification of AfIP-1A-31 and AfIP-1B-32 Homologs from Other *Alcaligenes faecalis* Strains Three additional *Alcaligenes faecalis* strains, ATCC_15554, ATCC_27066, and ATCC_33585, were obtained from the American Type Culture Collection (ATCC®) (10801 University Boulevard, Manassas, Va. 20110) and AfIP-1A-31 and AfIP-1B-32 orthologs were identified in a manner similar to those described in Examples 1-3. The protein homologs were designated as AfIP-1A-15554 (SEQ ID NO: 28), AfIP-1B-15554 (SEQ ID NO: 30), AfIP-1A-27066 (SEQ ID NO: 32), AfIP-1B-27066 (SEQ ID NO: 34), AfIP-1A-33585 (SEQ ID NO: 36), and AfIP-1B-33858 (SEQ ID NO: 38), respectively. The nucleic acid sequences encoding the orthologs are SEQ ID NO: 27 (AfIP-1A-15554), SEQ ID NO: 29 (AfIP-1B-15554), SEQ ID NO: 31 (AfIP-1A-27066), SEQ ID NO: 33 (AfIP-1B-27066), SEQ ID NO: 35 (AfIP-1A-33585) and SEQ ID NO:

37 (AfIP-1B-33858), respectively. The amino acid differences between the *Alcaligenes faecalis* strain homologs and AfIP-1A-31 are shown in sequence alignment of FIG. 1. The amino acid differences between the *Alcaligenes faecalis* strain homologs and AfIP-1B-32 are shown in sequence alignment of FIG. 2. Tables summarizing the global identity and similarity data (in parenthesis) are presented in Table 7A and Table 7B. Percent identity and similarity values were calculated using ClustalW algorithm in the ALIGNX® module of the Vector NTI® Program Suite (Invitrogen Corporation, Carlsbad, Calif.) with all default parameters.

TABLE 7A

| | AfIP-1A-15554 | AfIP-1A-27066 | AfIP-1A-33585 |
|---|---|---|---|
| AfIP-1A-31 | 100% | 99.3% (97.9%) | 97.3% (99.3%) |
| AfIP-1A-15554 | | 99.3% (97.9%) | 97.3% (99.3%) |
| AfIP-1A-27066 | | | 99.3% (100%) |
| AfIP-1A-33585 | | | 100% |

TABLE 7B

| | AfIP-1B-15554 | AfIP-1B-27066 | AfIP-1B-33585 |
|---|---|---|---|
| AfIP-1B-32 | 98% (98%) | 94.6% (95.9%) | 95.3% (96.9%) |
| AfIP-1B-15554 | | 96% (97.3%) | 96.8% (98.3%) |
| AfIP-1B-27066 | | | 98.1% (98.4%) |
| AfIP-1B-33585 | | | 100% |

Example 8

Creation of Variants of AfIP-1A-31 with Multiple Amino Acid Substitutions

To create variants of AfIP-1A-31 with multiple amino acid changes, two libraries (AfIP-1A-31LE & AfIP-1A-31HE) were generated by spiking oligos carrying two sets of amino acid changes listed in Table 8 using standard protocols as described in the literature (Statzman-Engwall, et al., (2005) *Metabolic Engineering* 7:27-37). After transforming into *E. coli* cells, 96 colonies were picked for each library and cultured in 96-well plates for protein expression. Cell lysates were generated by B-PER® Protein Extraction Reagent from Thermo Scientific (3747 N Meridian Rd, Rockford, Ill. USA 61101) and were screened for WCRW insecticidal activity after mixing with purified AfIP-1B-32. In parallel, the active AfIP-1A-31 variants were DNA sequenced.

TABLE 8

AfIP-1A-31 LE and HE Library design

| Library name | position | Change | Oligo |
|---|---|---|---|
| AfIP-1A-31LE | I20 | V | GCTTATGCGCAATGGRTTGAAATTACCATCTTCGTTGTTAAC SEQ ID NO: 154 |
| | I24 | L | GCTTATGCGCAATGGRTTGAAATTACCCTGTTCGTTGTTAAC SEQ ID NO: 155 |
| | V33 | I | TCAAACTTCAAARTTGAAAACGCTTATCTGAGGTGG SEQ ID NO: 156 |
| | G35 | N | TCAAACTTCAAARTTGAAGGTGCTTATCTGAGGTGG SEQ ID NO: 157 |
| | D48 | N | TTCCATGTGCCAGGAAACAAAGACAAGGAAATA SEQ ID NO: 158 |
| | S73 | A | TCATACACCATTGCCGCCTGCGGACGCGAGAAC SEQ ID NO: 159 |
| | V96 | I | GACGGTGATAAATTAATTTTTGAATATTACTGG SEQ ID NO: 160 |
| | D111 | N | AGTGGTTCCAACAGCAACGAGCTCACCGTTAAG SEQ ID NO: 161 |
| | A134 | P | GGTAGCCCAAGTGGCCCGACAGGCAATATCTTC SEQ ID NO: 162 |
| AfIP-1A-31HE | N30 | S | TTCGTTGTTAACTCAAGCTTCAAAGTAGAAGGT SEQ ID NO: 163 |
| | Q57<br>I58 | E<br>V | GAAATAAGTCCCAGCSAGRTCAACGGCACCRTCATCAAAGACGAA SEQ ID NO: 164 |
| | N59<br>I62 | E<br>V | GAAATAAGTCCCAGCSAGRTCGAGGGCACCRTCATCAAAGACGAA SEQ ID NO: 165 |
| | D67<br>S68 | E<br>T | ATCAAAGACGAAGAKASCTACACCATTGCCTCC SEQ ID NO: 166 |
| | T114<br>D117<br>N120 | S<br>E<br>K | AACAGCGATGAGCTCASCGTTAAGGAKAAAGAAAAMTACACAGTGATTAAA SEQ ID NO: 167 |

After combining the bioassay and sequencing data a panel of active clones with various degrees and combinations of mutations incorporated as shown in Table 9 were selected for further combination. Table 9 shows the mutagenized positions and the wild-type amino acids at those position of AfIP-1A-31 (SEQ ID NO: 2) and the amino acid substitutions at those positions in the AfIP-1A-31 variants.

Variants of AfIP-1A-31 were then designed and the genes synthesized (GenScript, Piscataway, N.J. 08854, USA) incorporating various combinations of mutations identified from the shuffled libraries of Table 9. The variant AfIP-1A-31 genes were cloned into *E. coli* cells and the AfIP-1A-31 variant polypeptides were purified using a His-tag affinity purification kit as described previously. The variant AfIP-1A-31 polypeptides were assayed against WCRW after combining with 100 ppm purified AfIP-1B-32 (His-tagged SEQ ID NO: 26) (200 ppm of the AfIP-1A-31 variant). Table 10 shows the sequences for the AfIP-1A-31 variant polypeptides that demonstrated insecticidal activity against WCRW. Table 10 shows the mutagenized positions and the wild-type amino acids at those position of AfIP-1A-31 (SEQ ID NO: 2) and the amino acid substitutions at those positions in the AfIP-1A-31 variants.

TABLE 9 amino acid changes of selected active mutants of AfIP-1A-31

| Position | % homology | 6 | 7 | 9 | 20 | 23 | 24 | 30 | 33 | 35 | 43 | 48 | 57 |
|---|---|---|---|---|---|---|---|---|---|---|---|---|---|
| AfIP-1A-31 (SEQ ID NO: 2) | | I | A | E | I | T | I | N | V | G | F | D | Q |
| HE-47 (SEQ ID NO: 40) | 97.9 | T | | | | A | L | | | | | | |
| HE-50 (SEQ ID NO: 42) | 96.5 | | | G | | | | S | | | | | E |
| HE-54 (SEQ ID NO: 44) | 95.8 | T | V | | | | | S | | | | | |
| HE-64 (SEQ ID NO: 46) | 97.2 | | | | | | | | | | Y | | E |
| HE-80 (SEQ ID NO: 48) | 97.2 | | | | | | | S | | | | | |
| HE-82 (SEQ ID NO: 50) | 97.9 | | | | | | | | | | | | E |
| LE-47 (SEQ ID NO: 52) | 97.9 | | | | | | | | | | | N | |
| LE-76 (SEQ ID NO: 54) | 99.3 | | | | | | | | | | | | |
| LE-78 (SEQ ID NO: 56) | 96.5 | | | | V | | L | | I | N | | | |
| LE-84 (SEQ ID NO: 58) | 97.2 | | | | | | L | | | | | | |

| Position | 58 | 59 | 62 | 64 | 67 | 73 | 80 | 111 | 114 | 117 | 134 | 137 |
|---|---|---|---|---|---|---|---|---|---|---|---|---|
| AfIP-1A-31 (SEQ ID NO: 2) | I | N | I | K | D | S | S | D | T | D | A | N |
| HE-47 (SEQ ID NO: 40) | | | | | | | | | | | | |
| HE-50 (SEQ ID NO: 42) | | E | V | | | | | | | | | |
| HE-54 (SEQ ID NO: 44) | | E | V | | E | | | | | | | |
| HE-64 (SEQ ID NO: 46) | V | E | | | | | | | | | | |
| HE-80 (SEQ ID NO: 48) | | | | E | | | | | S | E | | |
| HE-82 (SEQ ID NO: 50) | V | | | | | | P | | | | | |
| LE-47 (SEQ ID NO: 52) | | | | | | A | | N | | | | |
| LE-76 (SEQ ID NO: 54) | | | | | | A | | | | | | |
| LE-78 (SEQ ID NO: 56) | | | | | | | | | | | P | |
| LE-84 (SEQ ID NO: 58) | V | | | | | A | | | | | | S |

TABLE 10

Active variants with combined mutations of AfIP-1A-31

| Position | % IDENTITY | 6 | 7 | 9 | 20 | 23 | 24 | 30 | 33 | 35 | 43 | 48 | 57 | 58 | 59 |
|---|---|---|---|---|---|---|---|---|---|---|---|---|---|---|---|
| AfIP-1A-31 (SEQ ID NO: 2) | | I | A | E | I | T | I | N | V | G | F | D | Q | I | N |

TABLE 10-continued

Active variants with combined mutations of AfIP-1A-31

| | | | | | | | | | | | | | | |
|---|---|---|---|---|---|---|---|---|---|---|---|---|---|---|
| AfIP-1A-31-95-1 (SEQ ID NO: 60) | 94.1 | T | V | | | | | S | | | | | | E |
| AfIP-1A-31-95-2 (SEQ ID NO: 62) | 94.1 | | | | V | | L | S | I | | | | | |
| AfIP-1A-31-90 (SEQ ID NO: 64) | 88.9 | T | V | | V | | L | S | I | | | | E | V | E |
| AfIP-1A-31-88 (SEQ ID NO: 66) | 87.6 | T | V | | V | A | L | S | I | | Y | N | E | V | E |
| AfIP-1A-31-86 (SEQ ID NO: 68) | 85.3 | T | V | | V | | L | S | I | | Y | N | E | V | E |
| AfIP-1A-31-85-1 (SEQ ID NO: 70) | 84.9 | T | V | G | V | | L | S | I | N | Y | N | E | V | E |
| AfIP-1A-31-85-2 (SEQ ID NO: 72) | 84.9 | T | V | G | V | A | L | S | I | | Y | N | E | V | E |
| AfIP-1A-31-85-3 (SEQ ID NO: 74) | 84.9 | T | V | G | V | A | L | S | I | | Y | N | E | V | E |

| Position | 62 | 64 | 67 | 68 | 73 | 80 | 96 | 111 | 114 | 117 | 126 | 134 | 137 |
|---|---|---|---|---|---|---|---|---|---|---|---|---|---|
| AfIP-1A-31 (SEQ ID NO: 2) | I | K | D | S | S | S | V | D | T | D | K | A | N |
| AfIP-1A-31-95-1 (SEQ ID NO: 60) | V | | E | | | | | | S | E | | | |
| AfIP-1A-31-95-2 (SEQ ID NO: 62) | | E | | | | | | | S | E | | P | |
| AfIP-1A-31-90 (SEQ ID NO: 64) | V | | E | | A | | | N | S | E | | | |
| AfIP-1A-31-88 (SEQ ID NO: 66) | V | | E | | A | | | N | S | E | | | |
| AfIP-1A-31-86 (SEQ ID NO: 68) | V | | E | T | A | | I | N | S | E | R | | |
| AfIP-1A-31-85-1 (SEQ ID NO: 70) | V | | E | | A | P | | N | S | E | | P | S |
| AfIP-1A-31-85-2 (SEQ ID NO: 72) | V | | E | | A | P | | N | S | E | | P | S |
| AfIP-1A-31-85-3 (SEQ ID NO: 74) | V | | E | T | A | S | I | N | S | E | R | | |

Example 9

Identification of Amino Acid Positions Affecting the Protein Stability and Function of AfIP-1A-31

The protein sequence alignment of: AfIP-1A-31 (SEQ ID NO: 2); *active closely* related *Alcaligenes faecalis* orthologs; AfIP-1A-15554 (SEQ ID NO: 28), AfIP-1A-27066 (SEQ ID NO: 32) and AfIP-1A-33585 (SEQ ID NO: 36); the distantly related active homolog FGTW-51 (SEQ ID NO: 18); the distant related inactive homolog Slin6118 (SEQ ID NO: 14) and several aegerolysin-like proteins is shown in FIG. 3. Secondary structure features of AfIP-1A-31 (SEQ ID NO: 2) were obtained using the "Peptide Structure" program within SeqWeb v3.1.2 and selected structure features according to Garnier-Osguthorpe-Robson predictions are shown above the alignment of FIG. 1. From the alignment five conserved AfIP-1A-31 motifs were identified, amino acids 15-26 of SEQ ID NO: 2 (motif 1), amino acids 33-53 of SEQ ID NO: 2 (motif 2), amino acids 71-84 of SEQ ID NO: 2 (motif 3), amino acids 100-107 of SEQ ID NO: 2 (motif 4) and amino acids 132-140 of SEQ ID NO: 2 (motif 5) of AfIP-1A-31 (SEQ ID NO: 1).

To further define the sequence space within those five selected motifs and their role in insecticidal activity amino acids 19 and 20 (in motif 1), amino acids 36, 37, 38, 39, 40, 41, 42, 43, 44, 45 and 46 (motif 2), amino acids 74, 75, 76, 82 (motif 3), amino acids 101, 104, 105 (motif 4), and amino acids 132 to 140 (motif 5) of AfIP-1A-31 (SEQ ID NO: 2) were selected for saturation mutagenesis. Saturated mutagenesis was designed for selected position of the motifs using the mutagenesis oligonucleotides as shown in Table 11 for motifs 1, 3 and 4, Table 12 for motif 2 and Table 13 for motif 5. Mutants were generated using degenerate oligos for each site using sewing and rescuing PCR strategy of two overlapping fragments of N-terminus (no mutation) and C-terminus (with mutations) for each site using sewing and rescuing PCR strategy of two overlapping fragments of N-terminus (no mutation) and C-terminus (with mutations) gene). Table 14 shows the amino acid substitutions identified at each position of motifs 1, 3 and 4 that were mutagenized, the amino acid substitutions that expressed a soluble protein in the cell lysate, and sequence variations within the motifs that allow retention of insecticidal activity were identified. Table 15 shows the amino acid substitutions identified at each position of motif 2 that were mutagenized, the amino acid substitutions that expressed a soluble protein in the cell lysate and sequence variations within the motifs that allow retention of insecticidal activity (>10 on a scale of 18). Table 16 shows the amino acid substitutions identified at each position of motif 5 that were mutagenized, the amino acid substitutions that expressed a soluble protein in the cell lysate and sequence variations within the motifs that allow retention of insecticidal activity (>10 on a scale of 18).

TABLE 11

| Motif | Amino acid residue | Oligo name | Sequence |
|---|---|---|---|
| 1 | W19 | AfIP-1A-31-W19R | TTGCGCATAAGCCCGAATCTT SEQ ID NO: 168 |
| | | AfIP-1A-31-W19F | AAGATTCGGGCTTATGCGCAANNKATAGAAATTACCATATTCGTT SEQ ID NO: 169 |
| | I20 | AfIP-1A-31-I20R | CCATTGCGCATAAGCCCGAAT SEQ ID NO: 170 |
| | | AfIP-1A-31-I20F | ATTCGGGCTTATGCGCAATGGNNKGAAATTACCATATTCGTTGTT SEQ ID NO: 171 |
| 3 | C74 | AfIP-1A-31-C74R | GGAGGCAATGGTGTATGAGTC SEQ ID NO: 178 |
| | | AfIP-1A-31-C74F | GACTCATACACCATTGCCTCCNNKGGACGCGAGAACGCCTCGTCA SEQ ID NO: 179 |
| | G75 | AfIP-1A-31-G75R | GCAGGAGGCAATGGTGTATGA SEQ ID NO: 180 |
| | | AfIP-1A-31-G75F | TCATACACCATTGCCTCCTGCNNKCGCGAGAACGCCTCGTCAGGA SEQ ID NO: 181 |
| | R76 | AfIP-1A-31-R76R | TCCGCAGGAGGCAATGGTGTA SEQ ID NO: 182 |
| | | AfIP-1A-31-R76F | TACACCATTGCCTCCTGCGGANNKGAGAACGCCTCGTCAGGAACT SEQ ID NO: 183 |
| | G82 | AfIP-1A-31-G82R | TGACGAGGCGTTCTCGCGTCC SEQ ID NO: 184 |
| | | AfIP-1A-31-G82F | GGACGCGAGAACGCCTCGTCANNKACTGAAGGAGGTTTCTCCCTG SEQ ID NO: 185 |
| 4 | W101 | AfIP-1A-31-W101R | GTAATATTCAAAAACTAATTT SEQ ID NO: 186 |
| | | AfIP-1A-31-W101F | AAATTAGTTTTTGAATATTACNNKGATTGCCCCTGGAGTGGTTCC SEQ ID NO: 187 |
| | P104 | AfIP-1A-31-P104R | GCAATCCCAGTAATATTCAAA SEQ ID NO: 188 |
| | | AfIP-1A-31-P104F | TTTGAATATTACTGGGATTGCNNKTGGAGTGGTTCCAACAGCGATG SEQ ID NO: 189 |
| | W105 | AfIP-1A-31-W105R | GGGGCAATCCCAGTAATATTC SEQ ID NO: 190 |
| | | AfIP-1A-31-W105F | GAATATTACTGGGATTGCCCCNNKAGTGGTTCCAACAGCGATGAG SEQ ID NO: 191 |

TABLE 12

| Motif | Amino acid Residue | Oligo name | Sequence |
|---|---|---|---|
| 2 | A36 | AfIP-1A-31-A36F | CTCAAACTTCAAAGTAGAAGGTNNKTATCTGAGGTGGGGAAAGTTC SEQ ID NO: 260 |
| | | AfIP-1A-31-A36R | ACCTTCTACTTTGAAGTTTGAG SEQ ID NO: 261 |
| | Y37 | AfIP-1A-31-Y37F | AACTTCAAAGTAGAAGGTGCTNNKCTGAGGTGGGGAAAGTTCCAT SEQ ID NO: 262 |
| | | AfIP-1A-31-Y37R | AGCACCTTCTACTTTGAAGTT SEQ ID NO: 263 |

TABLE 12-continued

| Motif | Amino acid Residue | Oligo name | Sequence |
|---|---|---|---|
| | L38 | AfIP-1A-31-L38F | CTTCAAAGTAGAAGGTGCTTATNNKAGGTGGGGAAAGTTCCATGTGC SEQ ID NO: 264 |
| | | AfIP-1A-31-L38R | ATAAGCACCTTCTACTTTGAAG SEQ ID NO: 265 |
| | R39 | AfIP-1A-31-R39F | CAAAGTAGAAGGTGCTTATCTGNNKTGGGGAAAGTTCCATGTGCCAG SEQ ID NO: 266 |
| | | AfIP-1A-31-R39R | CAGATAAGCACCTTCTACTTTG SEQ ID NO: 267 |
| | W40 | AfIP-1A-31-W40R | CCTCAGATAAGCACCTTCTAC SEQ ID NO: 172 |
| | | AfIP-1A-31-W40F | GTAGAAGGTGCTTATCTGAGGNNKGGAAAGTTCCATGTGCCAGGA SEQ ID NO: 173 |
| | G41 | AfIP-1A-31-G41R | CCACCTCAGATAAGCACCTTC SEQ ID NO: 174 |
| | | AfIP-1A-31-G41F | GAAGGTGCTTATCTGAGGTGGNNKAAGTTCCATGTGCCAGGAGAT SEQ ID NO: 175 |
| | K42 | AfIP-1A-31-K42R | TCCCCACCTCAGATAAGCACC SEQ ID NO: 176 |
| | | AfIP-1A-31-K42F | GGTGCTTATCTGAGGTGGGGANNKTTCCATGTGCCAGGAGATAAA SEQ ID NO: 172 |
| | F43 | AfIP-1A-31-F43F | TGCTTATCTGAGGTGGGGAAAGNNKCATGTGCCAGGAGATAAAGACA SEQ ID NO: 268 |
| | | AfIP-1A-31-F43R | CTTTCCCCACCTCAGATAAGCA SEQ ID NO: 269 |
| | H44 | AfIP-1A-31-H44F | TATCTGAGGTGGGGAAAGTTCNNKGTGCCAGGAGATAAAGACAAG SEQ ID NO: 270 |
| | | AfIP-1A-31-H44R | GAACTTTCCCCACCTCAGATAAG SEQ ID NO: 271 |
| | V45 | AfIP-1A-31-V45F | TCTGAGGTGGGGAAAGTTCCATNNKCCAGGAGATAAAGACAAGGAAAT SEQ ID NO: 272 |
| | | AfIP-1A-31-V45R | ATGGAACTTTCCCCACCTCAGA SEQ ID NO: 273 |
| | P46 | AfIP-1A-31-P46F | AGGTGGGGAAAGTTCCATGTGNNKGGAGATAAAGACAAGGAAATAA SEQ ID NO: 274 |
| | | AfIP-1A-31-P46R | CACATGGAACTTTCCCCACCT SEQ ID NO: 275 |

TABLE 13

| Amino acid Residue | Oligo name | Sequence |
|---|---|---|
| S132 | AfIP-1A-31-S132R | TGGGCTACCGCCACCT SEQ ID NO: 192 |
| | AfIP-1A-31-S132F | AGGTGGCGGTAGCCCANNKGGCGCGACAGGCAATATC SEQ ID NO: 193 |
| G133 | AfIP-1A-31-G133R | ACTTGGGCTACCGCCAC SEQ ID NO: 194 |
| | AfIP-1A-31-G133F | GTGGCGGTAGCCCAAGTNNKGCGACAGGCAATATCTTC SEQ ID NO: 195 |

TABLE 13-continued

| Amino acid Residue | Oligo name | Sequence |
|---|---|---|
| A134 | AfIP-1A-31-A134R | GCCACTTGGGCTACCGC SEQ ID NO: 196 |
| | AfIP-1A-31-A134F | GCGGTAGCCCAAGTGGCNNKACAGGCAATATCTTCATTAC SEQ ID NO: 197 |
| T135 | AfIP-1A-31-T135R | CGCGCCACTTGGGCTACC SEQ ID NO: 198 |
| | AfIP-1A-31-T135F | GGTAGCCCAAGTGGCGCGNNKGGCAATATCTTCATTACTG SEQ ID NO: 199 |
| G136 | AfIP-1A-31-G136R | TGTCGCGCCACTTGGGCTAC SEQ ID NO: 200 |
| | AfIP-1A-31-G136F | GTAGCCCAAGTGGCGCGACANNKAATATCTTCATTACTGTTG SEQ ID NO: 201 |
| N137 | AfIP-1A-31-N137R | GCCTGTCGCGCCACTTGG SEQ ID NO: 202 |
| | AfIP-1A-31-N137F | CCAAGTGGCGCGACAGGCNNKATCTTCATTACTGTTGTCA SEQ ID NO: 203 |
| I138 | AfIP-1A-31-I138R | ATTGCCTGTCGCGCCACT SEQ ID NO: 204 |
| | AfIP-1A-31-I138F | AGTGGCGCGACAGGCAATNNKTTCATTACTGTTGTCAAA SEQ ID NO: 205 |
| F139 | AfIP-1A-31-F139R | GATATTGCCTGTCGCGCCAC SEQ ID NO: 206 |
| | AfIP-1A-31-F139F | CGCGACAGGCAATATCNNKATTACTGTTGTCAAAAAATCCCT SEQ ID NO: 207 |
| I140 | AfIP-1A-31-I140R | GAAGATATTGCCTGTCGCGC SEQ ID NO: 208 |
| | AfIP-1A-31-I140F | GACAGGCAATATCTTCNNKACTGTTGTCAAAAAATCCCTCG SEQ ID NO: 209 |

TABLE 14

| Motif | Amino acid Position | Identified mutations | Soluble expressed Mutants | Active mutants |
|---|---|---|---|---|
| 1 | W19 | A, C, D, E, F, G, H, I, K, L, M, N, P, Q, R, S, T, V, Y | A, C, D, E, F, G, H, I, K, L, M, N, P, Q, R, S, T, V, Y | E, F, I, H, N, Y |
| | I20 | A, C, D, E, F, G, H, K, L, M, N, P, Q, R, S, T, V, W, Y | A, C, E, F, G, K, M, N, P, Q, R, S, V, T | A, C, E, F, G, M, N, Q, R, S, T, V |
| 3 | C74 | A, D, E, F, G, H, I, K, L, M, N, P, Q, R, S, T, V, W, Y | A, D, E, G, H, I, K, L, N, P, Q, R, S, T, Y | A, D, E, G, H, I, K, L, N, P, Q, R, S, T, Y |
| | G75 | A, C, D, E, F, H, I, K, L, M, N, P, Q, R, S, T, V, W, Y | A, D, E, F, H, I, K, L, M, N, P, Q, R, S, T, W, Y | |
| | R76 | A, C, D, E, F, G, H, I, K, L, M, N, P, Q, S, T, V, W, Y | A, C, D, E, F, G, H, I, K L, M, N, P, Q, S, T, V, W, Y | A, C, D, E, F, G, H, I, K, L, M, N, P, Q, S, T, V, W, Y |
| | G82 | A, C, D, E, F, H, I, K, L, M, N, P, Q, R, S, T, V, W, Y | C, D, E, F, H, I, K, L, N, P, T, V, W, Y | E, N, W, Y |
| 4 | W101 | A, C, D, E, F, G, H, I, K, L, M, N, P, Q, R, S, T, V, Y | A, C, D, E, F, G, I, K, L, M, N, P, Q, R, S, T, V, Y | F, Y |
| | P104 | A, D, E, F, G, H, I, K, L, M, N, Q, R, S, T, V, W, Y | A, D, E, G, H, K, L, M, N, Q, R, S, T, V, W | A, F, G, H, M, Q, R, V |
| | | A, C, D, E, F, G, H, I, K, | A, C, D, E, F, G, H, I, K, | D, F, I, L, Y |

TABLE 14-continued

| Motif | Amino acid Position | Identified mutations | Soluble expressed Mutants | Active mutants |
|---|---|---|---|---|
| | W105 | L, M, N, P, Q, R, S, T, V, Y | L, M, N, P, Q, R, S, T, V, Y | |

TABLE 15

| Amino acid Position | Identified mutations | Soluble expressed Mutants | Active mutants |
|---|---|---|---|
| A36 | D, E, F, G, H, I, K, L, P, Q, R, S, T, V, W, Y | D, E, F, G, H, I, K, L, P, Q, R, S, T, V, W, Y | D, E, F, G, I, K, L, P, Q, R, S, T, V, W, Y |
| Y37 | A, C, D, E, G, H, I, K, L, M, P, R, S, T, V, W | A, C, D, E, G, H, I, K, L, M, P, R, S, T, V, W | A, C, D, E, G, H, I, K, L, M, P, R, S, T, V, W |
| L38 | A, C, D, E, F, G, H, I, K, M, Q, R, S, T, V, W, Y | A, C, D, E, F, G, H, I, K, M, Q, R, S, T, V, W, Y | A, C, D, E, F, G, H, I, K, M, Q, R, S, T, V, W, Y |
| R39 | C, D, E, F, G, I, K, L, M, N, P, S, T, V, W, Y | C, D, E, F, G, I, K, L, M, N, P, S, T, V, **W**, Y | C, D, E, F, G, I, K, L, M, N, P, S, T, V, W, Y |
| W40 | A, C, D, E, F, G, H, I, K, L, M, N, P, Q, R, S, T, V, Y | A, C, D, E, F, G, H, I, K, L, M, N, P, Q, **R**, S, T, V, Y | A, C, D, E, F, G, H, I, K, L, M, N, P, Q, R, S, T, V, Y |
| G41 | A, C, D, E, F, H, I, K, L, M, N, P, Q, R, S, T, V, W, Y | A, C, E, F, H, I, K, L, N, P, Q, R, T, V, W, Y | C, Q |
| K42 | A, C, D, E, F, G, H, I, L, M, N, P, Q, R, S, T, V, W, Y | A, C, E, F, G, H, I, L, M, N, Q, R, S, T, V, W, Y | C, E, H, L, M, N, Q, R, T |
| F43 | A, C, D, E, G, H, I, K, L, M, P, Q, R, S, T, V, W | A, C, E, G, H, I, L, M, **Q**, S, V, W | A, C, E, I, L, M, **Q**, S, V, W |
| H44 | A, D, E, G, K, L, M, N, P, Q, R, S, T, V, W | A, D, E, G, K, L, M, N, P, Q, R, S, T, V, W | A, D, E, G, K, L, M, N, P, Q, R, S, T, V, W |
| V45 | A, C, D, E, F, G, H, I, K, L, N, P, Q, R, S, T, W | A, C, D, E, F, G, H, I, K, L, N, P, Q, R, S, T, W | A, C, D, E, F, G, H, I, K, L, N, P, Q, R, S, T, W |
| P46 | A, C, D, E, G, H, K, L, M, Q, R, S, T, V, W, Y | A, C, D, E, G, H, K, L, M, Q, R, S, T, V, W, Y | A, C, D, E, G, H, K, L, M, Q, R, S, T, V, W, Y |

TABLE 16

| Amino acid Position | Identified mutations | Soluble expressed Mutants | Active mutants |
|---|---|---|---|
| S132 | A, C, D, E, F, G, H, I, K, L, M, N, P, Q, R, T, V, W, Y | A, C, D, E, F, G, H, I, K, L, M, N, P, Q, R, T, V, W, Y | A, C, D, E, F, G, H, I, K, L, M, N, P, Q, R, T, V, W, Y |
| G133 | A, C, D, E, F, H, I, K, L, M, N, P, Q, R, S, T ,V, W, Y | A, C, D, E, F, H, I, K, L, M, N, P, Q, R, S, T, V, W, Y | A, C, D, E, F, H, I, K, L, M, N, P, Q, R, S, T, V, W |
| A134 | C, D, E, F, G, H, I, K, L, M, N, P, Q, R, S, T, V, W, Y | C, D, E, F, G, H, I, K, L, M, N, P, Q, R, S, T, V, W, Y | C, D, E, F, G, H, I, K, L, M, N, P, Q, R, S, T, V, W, Y |
| T135 | A, C, D, E, F, G, H, I, K, L, M, N, P, Q, R, S, V, W, Y | A, C, D, E, F, G, H, I, K, L, M, N, P, Q, R, S, V, W, Y | A, C, D, E, F, G, H, I, K, L, M, N, P, Q, R, S, V, W, Y |
| G136 | A, C, D, E, F, H, I, K, L, M N, P, Q, R, S, T, V, W, Y | A, C, D, E, F, H, I, K, L, M, N, P, Q, R, S, T, V, W, Y | A, C, D, E, F, H, I, K, L, M, N, P, Q, R, S, T, V, W, Y |
| N137 | A, C, D, E, F, G, H, I, K, L, M, P, Q, R, S, T, V, W, Y | A, C, D, E, F, G, H, I, K, L, M, P, Q, R, S, T, V, W, Y | A, C, D, E, F, G, H, I, K, L, M, P, Q, R, S, T, V, W, Y |
| I138 | A, C, D, E, F, G, H, K, L, M, N, P, Q, R, S, T, V, W, Y | A, C, D, E, F, G, H, K, L, M, N, P, Q, R, S, T, V, W, Y | A, C, D, E, F, G, H, K, L, M, N, P, Q, R, S, T, V, W, Y |
| F139 | A, C, D, E, G, H, I, K, L, M, N, P, Q, R, S, T, V, W, Y | A, C, D, E, G, H, I, K, L, M, N, P, Q, R, S, T, V, W, Y | A, C, D ,E, G, H, I, K, L, M, N, P, Q, R, S, T, V, W, Y |
| I140 | A, C, D, E, F, G, H, K, L, M, N, P, Q, R, S, T, V, W, Y | A, C, F, L, M, N, Q, T, V, Y | A, C, F, H, L, M, N, Q, T, V |

Example 10

Generation of additional Variants of AfIP-1A-31

Polynucleotides encoding additional AfIP-1A-31 variants were synthesized as described previously for use in protein crystallography and other studies.

A36G (n.a. SEQ ID NO: 93) (a.a. SEQ ID NO: 94)

V115I (n.a. SEQ ID NO: 95) (a.a. SEQ ID NO: 96)

I20M & I138M (n.a. SEQ ID NO: 97) (a.a. SEQ ID NO: 98)

I20M & T135M (n.a. SEQ ID NO: 99) (a.a. SEQ ID NO: 100)

These AfIP-1A-31 variants were expressed in *E. coli* as described above and clear lysates were found to have insecticidal activity when combined with AfIP-1B-32.

Example 11

Generation of AfIP-1B-32 Variants with Multiple Amino Acid Substitutions

To incorporate amino acid changes into AfIP-1B-32, two libraries (AfIP-1B-32LE & AfIP-1B-32HE) were generated by spiking oligos carrying two sets of amino acid changes shown in Table 17 using standard protocol as described in the literature (Statzman-Engwall, et al., (2005) *Metabolic Engineering* 7:27-37). Constructs were transformed into *E. coli* cells, 96 colonies were picked for each library and cultured in 96-well plates for protein expression. Cell lysates were generated by B-PER® Protein Extraction Reagent from Thermo Scientific (3747 N Meridian Rd, Rockford, Ill. USA 61101) and assayed against WCRW after mixing with purified AfIP-1A-31 (His-tagged SEQ ID NO: 24). In parallel, DNA sequencing was performed on those clones. After combining the bioassay and sequencing data, a panel of active clones was selected with various numbers of mutations incorporated as listed in Table 18.

TABLE 17

AfIP-1B-32 LE and HE Library design

| Library name | position | change | Oligo |
|---|---|---|---|
| AfIP-1B-32LE | E42 | D | ATGATTACCCAAAAAGACATTGAAATGGGTATG SEQ ID NO: 210 |
| | D115 | E | CTCTACCGTCAGATTTTCAAAGTCGATATATTC SEQ ID NO: 211 |
| | F141 | Y | GTCACGGGCAGCAATATATTTCTCTAAAACCTT SEQ ID NO: 212 |
| | E352 | D | ATTGATGGCTTGAATGACCTGGCATCCAAAGTC SEQ ID NO: 213 |
| | Y393 | F | GATTCAAGCTCAGACTTCGCCGTTTTAGGCGCC SEQ ID NO: 214 |
| | E422 | D | GAAATCAGTGATGCTGACGTTGCGGAGTACATC SEQ ID NO: 215 |
| | E696 | D | TATATCGGAACCGTTGATAAAATCAACAGTATA SEQ ID NO: 216 |
| | E323 | D | CTTGCGTCCGGATATGACGAAGCCAAAAAAACA SEQ ID NO: 217 |
| | F490 | Y | GCGGTAGAAATCGCATACAATTCCTTAAGCGAT SEQ ID NO: 218 |
| | Y550 | F | GCAGCTTATTGCAGCTTCGGAAACAACAACCCG SEQ ID NO: 219 |
| | Y625 | F | TTGATACCTATTCCATTTTCTGCCGCCAAGGGA SEQ ID NO: 220 |
| AfIP-1B-32HE | E139 | D | TCGTTAAAGGTTTTAGACAAATTCATTGCTGCC SEQ ID NO: 221 |
| | D155<br>E156 | E<br>D | TCGTCTATAGAAAAAGAKGAKCTCATGAAAGAATGG<br>SEQ ID NO: 222 |
| | Y172 | F | AACTTCATTTCATCCTTCGGGGATGGTCTGGTC SEQ ID NO: 223 |
| | E208 | D | TATGGAGAAACGGCTGACTTCAGCTATTCAGGG SEQ ID NO: 224 |
| | E234 | D | AAAGATCAAAGCTCTGATGTTGAGGTATCTTGC SEQ ID NO: 225 |
| | E299 | D | CCGGAAAAAAATGCAGACATAACGGAAAAGCTG SEQ ID NO: 226 |
| | D305 | E | ATAACGGAAAAGCTGGAGACCATTAAAAAGCTG SEQ ID NO: 227 |
| | E335 | D | CCGAACTTAACTTTTGACGAATTCAAATCAACT SEQ ID NO: 228 |
| | D388 | E | AGAACAATCAGCTTAGAGTCAAGCTCAGACTAC SEQ ID NO: 229 |
| | E481 | D | TTAAGCGACMCGTAGATAGTGACGATGCGGTA SEQ ID NO: 230 |
| | D495 | E | TTCAATTCCTTAAGCGAAGAAGCCAAGAAGATT SEQ ID NO: 231 |
| | Y538 | F | GTTAAGCCGATACCGTTTCCCGAGGTCACCTAC SEQ ID NO: 232 |

TABLE 18 amino acid changes of selected active mutants of AfIP-1B-32

| Position | % identity | 42 | 71 | 115 | 119 | 139 | 155 | 181 | 201 | 202 | 208 | 234 | 270 |
|---|---|---|---|---|---|---|---|---|---|---|---|---|---|
| AfIP-1B-32 (SEQ ID NO: 4) | | E | G | D | V | E | D | I | W | K | E | E | I |

TABLE 18-continued amino acid changes of selected active mutants of AfIP-1B-32

| | | | | | | | | | | | | | |
|---|---|---|---|---|---|---|---|---|---|---|---|---|---|
| AfIP-1B-32-HE19 (SEQ ID NO: 76) | 99.3 | | | | | D | E | | | | | | |
| AfIP-1B-32-HE74 (SEQ ID NO: 78) | 99.6 | | | | | D | | | | | | | |
| AfIP-1B-32-HE63 (SEQ ID NO: 80) | 99.3 | | | | | | | | | | D | D | |
| AfIP-1B-32-HE27 (SEQ ID NO: 82) | 99.3 | | | | | D | | | | | D | | |
| AfIP-1B-32-HE24 (SEQ ID NO: 84) | 99.6 | | C | | A | | | | | | | D | |
| AfIP-1B-32-LE5 (SEQ ID NO: 86) | 99.6 | | | | | | | V | | | | | |
| AfIP-1B-32-LE10 (SEQ ID NO: 88) | 99.3 | D | | | | | | | C | N | | | |
| AfIP-1B-32-LE67 (SEQ ID NO: 90) | 99.6 | | | | | | | | | | | | |
| AfIP-1B-32-LE55 (SEQ ID NO: 92) | 99.3 | | | E | | | | | | | | | V |

| Position | 305 | 323 | 335 | 352 | 388 | 393 | 481 | 495 | 538 | 550 | 625 | 683 | 696 |
|---|---|---|---|---|---|---|---|---|---|---|---|---|---|
| AfIP-1B-32 (SEQ ID NO: 4) | D | E | E | E | D | Y | E | D | Y | Y | Y | T | E |
| AfIP-1B-32-HE19 (SEQ ID NO: 76) | E | | | | E | | | | F | | | | |
| AfIP-1B-32-HE74 (SEQ ID NO: 78) | E | | | | | | D | | | | | | |
| AfIP-1B-32-HE63 (SEQ ID NO: 80) | | | D | | | | | | F | | | A | |
| AfIP-1B-32-HE27 (SEQ ID NO: 82) | | | D | | E | | | E | | | | | |
| AfIP-1B-32-HE24 (SEQ ID NO: 84) | | | | | | | | | | | | | |
| AfIP-1B-32-LE5 (SEQ ID NO: 86) | | D | | | | | | | | | | | |
| AfIP-1B-32-LE10 (SEQ ID NO: 88) | | D | | | | | | | | F | F | | |
| AfIP-1B-32-LE67 (SEQ ID NO: 90) | | | | D | | F | | | | | | | D |
| AfIP-1B-32-LE55 (SEQ ID NO: 92) | | | | | | F | | | | F | | | |

Example 12

Identification of Amino Acid Positions Affecting the Protein Stability and Function of AfIP-1B-32

The protein sequence alignment of: AfIP-1B-32 (SEQ ID NO: 4); active closely related *Alcaligenes faecalis* orthologs; AfIP-1B-15554 (SEQ ID NO: 30), AfIP-1B-27066 (SEQ ID NO: 34) and AfIP-1B-33585 (SEQ ID NO: 38); the distantly related active homolog FGTW-52 (SEQ ID NO: 20); the distantly related homolog Slin6117 (SEQ ID NO: 16); is shown in FIG. 3. Secondary structure features of AfIP-1B-32 (SEQ ID NO: 2) were obtained using program Garnier (EMBOSS Explorer) (Garnier, et al., (1978) *J. Mol. Biol.* 120:97-120). From the alignment five conserved AfIP-1B-32 motifs, amino acids 105-115 of SEQ ID NO: 4 (motif 1), amino acids 133-141 of SEQ ID NO: 4 (motif 2), amino acids 177-184 of SEQ ID NO: 4 (motif 3), amino acids 358-365 of SEQ ID NO: 4 (motif 4) and amino acids 511-520 of SEQ ID NO: 4 (motif 5) (motifs boxed in FIG. 3) of active protein (AfIP-1B-32 (SEQ ID NO: 4) were identified.

To further define the sequence space within the five selected motifs and their role in pesticidal activity amino acids I103, M105, G108, I109, E110, and Y111 of motif 1, amino acids V137, F141 of motif 2, amino acids G179, W182 of motif 3, amino acids E359, N360, S361, D363, V364, and L365 of motif 4 and amino acids F109, N512, F514, G516, and L519 of motif 5 of AfIP-1B-32 (SEQ ID NO: 4) were selected for saturation mutagenesis. Saturated mutagenesis was designed for each position of the motifs using the mutagenesis oligonucleotides as shown in Table 19. Table 20 shows the amino acid substitutions identified at each position that were mutagenized, the amino acid substitutions that expressed a soluble protein in the cell lysate and sequence variations within the motifs that allow retention of insecticidal activity (>10 on a scale of 18).

TABLE 19

| Motif | Amino acid residue | Oligo name | Sequence |
|---|---|---|---|
| 1 | I103 | AfIP-1B-32-I103R | AATATTGTAGGAGACTTTTATAG SEQ ID NO: 751 |
| | | AfIP-1B-32-I103F | CTATAAAAGTCTCCTACAATNNKTCCATGATCTCGGGAATAG SEQ ID NO: 752 |

TABLE 19-continued

| Motif | Amino acid residue | Oligo name | Sequence |
|---|---|---|---|
| | M105 | AfIP-1B-32-M105R | CATGGAAATATTGTAGGAGAC SEQ ID NO: 753 |
| | | AfIP-1B-32-M105F | GTCTCCTACAATATTTCCNNKATCTCGGGAATAGAATATATCG SEQ ID NO: 754 |
| | S107 | AfIP-1B-32-S107R | CGAGATCATGGAAATATTGTAGG SEQ ID NO: 755 |
| | | AfIP-1B-32-S107F | CCTACAATATTTCCATGATCNNKGGAATAGAATATATCGAC SEQ ID NO: 756 |
| | G108 | AfIP-1B-32-G108R | TCCCGAGATCATGGAAATATTG SEQ ID NO: 233 |
| | | AfIP-1B-32-G108F | CAATATTTCCATGATCTCGNNKATAGAATATATCGACTTTG SEQ ID NO: 234 |
| | I109 | AfIP-1B-32-I109R | TATTCCCGAGATCATGGAAATATTG SEQ ID NO: 757 |
| | | AfIP-1B-32-I019F | CAATATTTCCATGATCTCGGGANNKGAATATATCGACTTTGAC SEQ ID NO: 758 |
| | E110 | AfIP-1B-32-E110R | TTCTATTCCCGAGATCATGG SEQ ID NO: 759 |
| | | AfIP-1B-32-E110F | CCATGATCTCGGGAATANNKTATATCGACTTTGACAATCTG SEQ ID NO: 760 |
| | Y111 | AfIP-1B-32-Y111R | ATATTCTATTCCCGAGATCATG SEQ ID NO: 235 |
| | | AfIP-1B-32-Y111F | CATGATCTCGGGAATAGAANNKATCGACTTTGACAATCTGAC SEQ ID NO: 236 |
| 2 | V137 | AfIP-1B-32-V137R | AACCTTTAACGAAAGATTTTTAGG SEQ ID NO: 237 |
| | | AfIP-1B-32-V137F | CCTAAAAATCTTTCGTTAAAGNNKTTAGAGAAATTCATTGC SEQ ID NO: 238 |
| | F141 | AfIP-1B-32-F141R | GAATTTCTCTAAAACCTTTAACG SEQ ID NO: 239 |
| | | AfIP-1B-32-F141F | CGTTAAAGGTTTTAGAGAAANNKATTGCTGCCCGTGACTGCTC SEQ ID NO: 240 |
| 3 | G179 | AfIP-1B-32-G179R | TCCCACGACCAGACCATCCCCG SEQ ID NO: 241 |
| | | AfIP-1B-32-G179F | GGATGGTCTGGTCGTGNNKGCCATCTGGGGTGGAATGGGC SEQ ID NO: 242 |
| | W182 | AfIP-1B-32-W182R | CCAGATGGCTCCCACGACCAGACC SEQ ID NO: 243 |
| | | AfIP-1B-32-W182F | GGTCTGGTCGTGGGAGCCATCNNKGGTGGAATGGGCTCTG SEQ ID NO: 244 |
| 4 | K356 | AfIP-1B-32-K356R | TTTGGATGCCAGCTCATTCAAGCC SEQ ID NO: 761 |
| | | AfIP-1B-32-K356F | GGCTTGAATGAGCTGGCATCCNNKGTCCAGGAAAATTCATTGG SEQ ID NO: 762 |
| | E359 | AfIP-1B-32-E359R | TTCCTGGACTTTGGATGCCAGC SEQ ID NO: 763 |
| | | AfIP-1B-32-E359F | GCTGGCATCCAAAGTCCAGNNKAATTCATTGGATGTGCTAGC SEQ ID NO: 764 |
| | N360 | AfIP-1B-32-N360R | ATTTTCCTGGACTTTGGATGCC SEQ ID NO: 245 |

TABLE 19-continued

| Motif | Amino acid residue | Oligo name | Sequence |
|---|---|---|---|
| | | AfIP-1B-32-N360F | CCAAAGTCCAGGAANNKTCATTGGATGTGCTAGCAGAAGG SEQ ID NO: 246 |
| | S361 | AfIP-1B-32-S361R | TGAATTTTCCTGGACTTTGG SEQ ID NO: 765 |
| | | AfIP-1B-32-S361F | CCAAAGTCCAGGAAAATNNKTTGGATGTGCTAGCAGAAGGC SEQ ID NO: 766 |
| | D363 | AfIP-1B-32-D363R | ATCCAATGAATTTTCCTGGAC SEQ ID NO: 767 |
| | | AfIP-1B-32-D363F | GTCCAGGAAAATTCATTGNNKGTGCTAGCAGAAGGCAGCATTTCC SEQ ID NO: 768 |
| | V364 | AfIP-1B-32-v364R | CACATCCAATGAATTTTCCTGG SEQ ID NO: 247 |
| | | AfIP-1B-32-V364F | GTCCAGGAAAATTCATTGGATNNKCTAGCAGAAGGCAGCATTTCC SEQ ID NO: 248 |
| | L365 | AfIP-1B-32-L365R | TAGCACATCCAATGAATTTTCCTGG SEQ ID NO: 769 |
| | | AfIP-1B-32-L365F | CCAGGAAAATTCATTGGATGTGNNKGCAGAAGGCAGCATTTCC SEQ ID NO: 770 |
| 5 | F509 | AfIP-1B-32-F509R | GAAACCAATTTCGTTCCAGG SEQ ID NO: 771 |
| | | AfIP-1B-32-F509F | CCTGGAACGAAATTGGTNNKTTGCGCAACGCGGAGCTTGGCC SEQ ID NO: 772 |
| | N512 | AfIP-1B-32-N512R | GTTGCGCAAGAAACCAATTTCG SEQ ID NO: 249 |
| | | AfIP-1B-32-N512F | CGAAATTGGTTTCTTGCGCNNKGCGGAGCTTGGCCTGGGCC SEQ ID NO: 250 |
| | E514 | AfIP-1B-32-E514R | CTCCGCGTTGCGCAAGAAACC SEQ ID NO: 773 |
| | | AfIP-1B-32-E514F | GGTTTCTTGCGCAACGCGNNKCTTGGCCTGGGCCTGCTC SEQ ID NO: 774 |
| | G516 | AfIP-1B-32-G516R | GCCAGCTCCGCGTTGCGCAAG SEQ ID NO: 251 |
| | | AfIP-1B-32-G516F | CTTGCGCAACGCGGAGCTTNNKCTGGGCCTGCTCATTGG SEQ ID NO: 252 |
| | L519 | AfIP-1B-32-L519R | CAGGCCCAGGCCAAGCTCCGCG SEQ ID NO: 775 |
| | | AfIP-1B-32-L519F | CGCGGAGCTTGGCCTGGGCNNKCTCATTGGGGATCAGTCAGTAAGC SEQ ID NO: 776 |

TABLE 20

| Amino acid Position | | Identified mutations | Soluble expressed Mutants | Active mutants |
|---|---|---|---|---|
| Motif 1 | I103 | G, V, L, W, F, T, C, Y, N, Q, D, E, K, R, H | G, V, L, W, F, T, C, Y, N Q, D, E, K, R, H | G, V, L, W, F, T, C, E, R |
| | M105 | G, A, V, L, W, F, P, T, C, N, Q, D, R | G, V, L, W, F, P, T, C, N, Q, D, R | G, V, L, W, F, P, T, C, N, Q, R |
| | G108 | A, V, L, I, M, W, F, P, S, T, C, Y, N, Q, D, K, R, H | A, V, L, I, M, W, F, P, S, T, C, Y, N, Q, D, K, R, H | A, L, V, I, M, W, F, S, T, C, Y, N, Q, D, K, H |
| | I109 | G,A,V,L,M,W,F,P,S, C, N, E, R | G, A, V, L, M, W, F, P, S, C, N, E, R | A, V, L, M, W, F, P, C, N, E |
| | E110 | G, A, V, L, M, W, S, T, C, Y, D, R, H | G, A, V, L, M, W, S, T, C, Y, D, G, R, H | A, V, L, M, W, S, T, C, Y, D, R, H |

TABLE 20-continued

| | Amino acid Position | Identified mutations | Soluble expressed Mutants | Active mutants |
|---|---|---|---|---|
| | Y111 | G, A, V, L, I, M, W, S, T, CD, E, K, R, H | G, A, V, L, I, M, W, S, T, C E, K, R, H | D, G, A, V, L, I, M, W, S, T, C, D, E, K, R, H |
| Motif 2 | V137 | F, A, L, W, P, S, C, Y, D, E, R | F, A, L, W, P, S, C, Y, D, E, R | F, A, L, W, P, S, C, D, E, R |
| | F141 | V, L, I, W, S, C | V, L, I, W, S, C | V, L, I, W, S, C |
| Motif 3 | G179 | V, W, S, C, R | V, W, S, C, R | V, W, S, C, R |
| | W182 | G, A, V, L, M, S, C, E, R | G, A, V, L, M, S, C, E, R | G, A, V, L, M, S, C, E, R |
| Motif 4 | E359 | G, A, V, L, W, F, P, S, T, K, R | G, A, V, L, W, F, P, S, T, K, R | G, A, V, L, W, F, P, S, T, K, R |
| | N360 | G, A, V, L, I, M, F, P, S, T, N, D, K, R, H | G, A, V, L, I, M, F, P, S, T, N,D, K, R, H | G, V, L, I, M, F, P, T, N, D, K, R, H |
| | S361 | G, V, L, E | G, V, L, E | G, V, L, E |
| | D363 | G, V, L, I, W, S | G, V, L, I, W, S | G, L, I, W, S |
| | V364 | G, A, F, P, S, T, N, Q, D, E, K,R, H | G, A, F, P, S, T, N, Q, D, E, K, R, H | P, S, T , N, Q, D, E, K |
| | L365 | G, A, V, I, W, F, P, S, T, C, Y,Q, D, E, R, H | G, A, V, I, W, F, P, S, T, C, Y,Q, D, E, R, H | G, A, V, I, W, F, P, S, T, C, Y,Q, D, E, R, H |
| Motif 5 | F509 | G, A, V, L, I, M, W, S, C, Y, N, D, E, R | G, A, V, L, I, M, W, S, C, Y, N,D, E, R | G, A, V, L, I, M, W, S, C, Y, N, D, E, R |
| | N512 | G, A, L, M, W, F, S, T, C, Q, R | G, A, L, M, W, F, S, T, C, Q, R | G, A, L, M, W, F, S, T, C, |
| | E514 | G, V, L, I, C, Y, D, K, R | G, V, L, I, C, Y, D, K, R | Q, R,G, I, D, R |
| | G516 | A, V, M, P, S, T, C, Y, N, Q, D, E, K, R | A, V, M, P, S, T, C, Y, N, Q, D, E, K, R | A, V, M, P, T, N, Q, D, E, K |
| | L519 | G, A, V, M, F, P, Y, Q, D, K, R | G, A, V, M, F, P, Y, Q, D, K, R | G, A, V, M, F, P, Y, Q, D, K, R |

Example 13

Trypsin and WCRW Gut Fluid Processing of AfIP-1A-31 and AfIP-1B-32

Mid guts were dissected from 100 third instar WCRW larvae into 200 μL PBS on ice. The suspension was centrifuged at 20,000 g for 15 min and the supernatant aliquoted and frozen at −80° C. prior to use. Two microliter of gut fluid was incubated with 15 μg AfIP-1A-31 or AfIP-1B-32 in 20 μL PBS at 30° C. for 2 hrs. AfIP-1A-31 and AfIP-1B-32 were also trypsinized by shaking with trypsin-Sepharose (Pierce) at 37° C. for 2 hours. Following digestion, the digested protein was recovered by placing the resin+sample solution into a spin filter and collecting the filtrate. The digested samples were evaluated with SDS PAGE and the N-terminal of the digestion products of digestion was determined by Edman sequence analysis. The major AfIP-1A-31 processed product after trypsin or gut fluid treatment had the amino acids AYAQWIEI (a.a. 1-8 of SEQ ID NO: 2) at its N-terminus. A polynucleotide (SEQ ID NO: 151) was synthesized encoding a AfIP-1A-31 polypeptide having the deletion of the first 14 amino acids preceded by an initiator methionine (SEQ ID NO: 152), expressed in *E. coli*, and found to have insecticidal activity when combined with AfIP-1B-32 (SEQ ID NO: 4 or SEQ ID NO: 26). Minor processed products of AfIP-1A-31 with the amino acid sequence DIATEESK (a.a. 5-12 of SEQ ID NO: 2) at its N-terminus or the amino acid sequence EESKI (a.a. 9-13 of SEQ ID NO: 2) at its N-terminus after trypsin digestion were also detected. Trypsin or gut fluid digest of AfIP-1B-32 (SEQ ID NO: 4) resulted in two major products. One form corresponding to a ~42 kDa band represented the N-terminal portion of AfIP-1B-32 (SEQ ID NO: 4). Edman sequencing showed that the N-terminal amino acid sequence was MDIEAKSINPLMG (a.a. 1-13 of SEQ ID NO: 4). The other product migrated as a ~38 kDa gel band. It represented the C-terminal portion of AfIP-1B-32 starting at GVRTISLDSSS (a.a. 381-703 of SEQ ID NO: 4). The trypsinized or gut fluid-digested AfIP-1A-31 (SEQ ID NO: 2) and AfIP-1B-32 (SEQ ID NO: 4) were incorporated into the diet of WCRW neonates and found to be just as inhibitory as undigested AfIP-1A-31 (SEQ ID NO: 2) and AfIP-1B-32 (SEQ ID NO: 4).

Example 14

Lack of Cross Resistance of AfIP-1A-31 Polypeptide and AfIP-1B-32 Polypeptide in mCry3A Resistant Strain of WCRW To determine if insects resistant to Cry proteins were cross resistant to AfIP-1A-31 and AfIP-1B-32 Western Corn Rootworm (WCRW, *Diabrotica virgifera* virgifera) larvae, susceptible or resistant to mCry3A, were treated with AfIP-1A-31 and AfIP-1B-32. FIG. 6 shows the amino acid sequence alignment of AfIP-1A-31 (SEQ ID NO: 2), FGTW-51 (SEQ ID NO: 18), Slin6118_GI_284040949_Aegerolysin_S_Iinguale (SEQ ID NO: 14) and the Cry3A protein of SEQ ID NO: 276. FIG. 7 shows the amino acid sequence alignment of AfIP-1B-32 (SEQ ID NO: 4) and the Cry3A protein of SEQ ID NO: 276. AfIP-1A-31 (SEQ ID NO: 2) and the Cry3A protein of SEQ ID NO: 276 share only 2.5% identity, while AfIP-1B-32 (SEQ ID NO: 4) and the Cry3A protein of SEQ ID NO: 276 share only 12.3% identity, indicating the proteins are unrelated.

A Cry3A-Resistant Colony was initiated by collecting approximately 9,000 western corn rootworm adults from the fields in three states (near Champaign, Ill.; Maysville, Iowa; and Clay Center, Nebr.) in August and September of 2009. Beetles from each location were caged separately in the laboratory and approximately 30,000-50,000 eggs were collected from each of the three colonies. The eggs were stored at 10° C. for 6 months, and then incubated at 25° C. until initial hatch was observed. Eggs were washed from soil in April 2010 using a 60 mesh sieve, then eggs were infested onto seedling maize and reared to adults (5,000-6,000 beetles from each colony). Bulk crossed were made of approximately 1,400-2,000 males from each field collected colony with similar number of females from the non-diapausing (ND) Pioneer Insectary colony, which originated from Brookings, S. Dak. Introgressing the non-diapausing trait eliminates obligate diapause and enables more rapid cycling of rootworm population selection. F1 eggs produced from each cross were allowed to hatch without diapausing period, and were infested onto seedling maize and reared to F1 adults. All F1 adults from all three crosses were pooled in oviposition cages for producing combined F2 eggs. F2 eggs were then infested onto seedling maize and reared to F2 adults. This process initiated the Cry3A-Res colony.

The Cry3A-Res colony was first selected in November 2010 with eggs from the F3 generation after introgressing the non-diapausing trait. Approximately 346,500 F3 eggs were infested onto seedling maize containing a high expressing mCry3A event (>10,000 ppm mCry3A expression of total protein in TO roots) with an average hatching rate 19%. A total of 210 insects survived to adulthood during this initial resistance selection by continuous exposure to the event expressing mCry3A. The survival rate from eggs to adults on the event was 0.06%. This process resulted in the F3 beetles of the Cry3A-Res colony after one selection as shown in Table 21. An un-selected isoline (Iso-CK) was reared on non-Bt seedling maize in each generation. All F3 survivors were collected into oviposition cages for mating and producing F4 eggs after the first selection. The F4 eggs and F5 eggs were infested on non-Bt corn seedlings for rearing and population ramping. Approximately 72,000 F6 eggs were infested onto seedling maize containing a high level expressing mCry3A event (>20,000 ppm mCry3A expression of total protein in TO roots) for the second selection. Further selections were repeated on F7, F8, F10, F12 and F14 using a high level expressing mCry3A maize event (>10,000 ppm mCry3A expression of total protein in TO roots). Additional selections were conducted on F14-H and later generations using a high expressing mCry3A maize event (>30,000 ppm mCry3A of total protein in roots). Table 21 shows that after six generations of selection the survival of F14 on mCry3A relative to non-Bt was 64.6%, which was >400-fold higher than the relative survival in the first selection (0.15%) with similar expression level. After three generations of selections (on F3, F6, F7), the resistance ratio (RR) to mCry3A in the Cry3A-Res colony was >90-fold based on LC50 (lethal concentration of 50% of the individuals, tested using F8 larvae), as shown in Table 21.

TABLE 21

| Generation # | Resistance selection # | Eggs exposed to mCry3A event for selection | Mean survival rate on mCry3A event (%) | Survival rate on non-Bt (%) | Survival on mCry3A event relative to non-Bt | RR to mCry3A after each selection* |
|---|---|---|---|---|---|---|
| F3 | 1 | 346,500 | 0.061 | 39.6 | 0.15 | 16 |
| F6-H** | 2 | 72,000 | 0.007 | N/A | >0.007 | — |
| F7 | 3 | 375 | 16.0 | N/A | >16 | >50 |
| F8 | 4 | 500 | 25.2 | 56.8 | 44.4 | >91 |
| F10 | 5 | 38,000 | 9.84 | 17.0 | 57.9 | >92 |
| F12 | 6 | 36,000 | 4.03 | 7.03 | 57.3 | >92 |
| F14 | 7 | 20,000 | 25.0 | 38.7 | 64.6 | — |
| F14-H** | >7 | 20,000 | 25.6 | (35.65% hatch) | >71.8 | — |

*RR, Resistance ratio = LC50 of Cry3A-Res colony/LC50 of ND lab colony

**F6-H and F14-H eggs were infested onto mCrySA events at higher mCrySA expression than events used in other selections.

The F11 beetles of the Cry3A-Res colony were used to make reciprocal mass crosses with a susceptible laboratory WCRW colony to test the inheritance of resistance. The eggs from the resistant homozygotes (R), F1 heterozygotes (RS), and susceptible homozygotes (S) were used to test dominance of resistance (h=0.20-0.21) based on 12-day survival on a high expressing mCry3A corn event relative to on non-Bt corn seeds. Analysis of 12-day relative survival results from F1 reciprocal crosses between the R and S colonies indicated that resistance to mCry3A in the mCry3A event was inherited autosomally and was incompletely recessive (h<0.5), as shown in Table 22.

TABLE 22

| WCRW colony or cross | % Relative survival on mCry3A event vs non-Bt, 12 d | Fitness | h* |
|---|---|---|---|
| R | 82.3 | 1.00 | |
| S | 7.0 | 0.09 | |
| S (female) × R | 23.2 | 0.28 | 0.21 |
| R (female) × S | 22.3 | 0.27 | 0.20 |

*h, Dominance of resistance.

Transcriptome analyses of the Cry3A-Res relative to other WCRW colonies and individuals showed that two Cry3A-Res individuals (Cry3A-Res-1 and Cry3A-Res-2) analyzed can be separated from the isoline susceptible WCRW (Iso-OK) or other reference colonies. Molecular markers based on the transcriptome analyses can be used for detection of the Cry3A-Res individuals.

Example 15

Fungicidal Activity of AfIP-1A-31 Polypeptide or AfIP-1B-32 Polypeptide

The antifungal activity of AfIP-1A-31 and AfIP-1B-32 alone and together against the fungal pathogens *Fusarium virguliforme* (FVR), *Fusarium oxysporum* (FOS), *Fusarium graminearum* (FGR), *Colletotrichum graminicola* (CGR) and *Exserohilum turcicum* (ETC) was assessed using a standard plate assay as described in U.S. Pat. No. 7,772,370. Briefly, new cultures were prepared every other week to maintain a consistent supply of spores. Spores were prepared from 2-4 week old cultures and spores were quantified using a hemocytometer, were diluted to the desired concentration with assay medium (¼×potato dextrose broth). AfIP-1A-31 and AfIP-1B-32 polypeptides at various concentrations were added to the plates at 50 μL/well for a standard assay plate or 25 μL/well for a half area plate. An equal volume of medium with fungal spores at 2 times the above concentrations was then added to start the assay. The plates were sealed with a gas permeable membrane (Breathe-Easy™, Cat. No. BEM-1, Diversified Biotech, Boston, Mass.) and the assay was allowed to develop in the dark at 28° C. for 24 to 48 hours. After the incubation period, the plates were placed on an inverted microscope and each well was examined and scored on a scale of 0-4, according to the following parameters: 0=no inhibition of fungal growth when compared to the negative control, 0.5=slight inhibition (overall growth is less than the negative control but growth from individual spores is not distinct), 1=slight inhibition (overall growth is less than the negative control but growth from individual spores is apparent, albeit not quite confluent), 2=moderate inhibition (growth from 1 spore can easily be identified and is significantly less abundant than the negative control; growth from each spore tends to look spherical), 3=strong inhibition (spores have germinated but growth is limited to a few branches of short hyphae), 4=complete inhibition (spores have not germinated.) See, for example, Duvick, et al., (1992) *J. Biol. Chem.* 267: 18814-18820. FIG. 8 shows the level of antifungal activity for AfIP-1A-31 and AfIP-1B-32 alone and together. AfIP-1A-31 and AfIP-1B-32 each showed antifungal activity independently.

Example 16

Transient Expression of AfIP-1A-31 Polypeptide and AfIP-1B-32 Polypeptide in Bush Beans *Phaseolus vulgaris*

Both the AfIP-1A-31 (SEQ ID NO: 1) and AfIP-1B-32 (SEQ ID NO: 3) genes were cloned into a transient expression vector each under control of a viral 35S promoter and a phaseolin terminator by Agro-infiltration as described (Kapila, et. al., (1997) *Plant Science* 122:101-108) to introduce an *Agrobacterium* cell suspension to intact tissues plant cells to confirm plant derived transgene expression. Briefly, young bush bean plantlets (common bean, *Phaseolus vulgaris*) were agro-infiltrated with normalized bacterial cell cultures of test and control strains. Leaf tissue was collected 4 days after Agro-infiltration, lyophilized and pulverized. Transient protein expression of both AfIP-1A-31 (SEQ ID NO: 2) and AfIP-1B-32 (SEQ ID NO: 4) was confirmed by western analysis.

Example 17

AfIP-1A-31 Polypeptide & AfIP-1B-32 Polypeptide Expression in Yeast

The AfIP-1A-31 and AfIP-1B-32 coding sequences were inserted in the yeast expression plasmids p413GDP for constitutive expression and p415GAL1 for galactose-inducible expression. Separate yeast strains were produced by transformation of strain BY4742 (ATCC, Manassas Va.) with p413GDP:AfIP-1A-31 and p413GPD:AfIP-1B-32 (ATCC, Manassas, Va.). Transformed colonies were selected on histidine-lacking media (MP Biochemicals, Solon Ohio) and grown at 28° C. The p413GDP:AfIP-1A-31 strain was then transformed with the p415GAL1:AfIP-1B-32 expression construct. The p413GPD:AfIP-1B-32 strain was transformed with the p415GAL1:AfIP-1A-31 expression construct. Transformed colonies containing both plasmids were selected on media lacking both histidine and leucine (MP Biochemicals, Solon Ohio). Similar numbers of colonies were recovered in the presence or absence of 2% galactose, indicating that there was no toxicity associated with the expression of AfIP-1A-31 and AfIP-1B-32 simultaneously in yeast. The presence of both plasmids was confirmed by restriction enzyme digestion. Cultures were grown in galactose-containing media (MP Biochemicals, Solon Ohio) at 28° C. Cleared lysates were produced by lysis of yeast cell pellets with Y-PER yeast protein extraction reagent (Thermo Scientific, Rockford Il.) followed by centrifugation. The presence of both proteins was confirmed by Western blot analysis. Cleared lysates were also shown to confer AfIP-1A-31-AfIP-1B-32 mediated toxicity to WCRW.

Example 18

Co-Administration of AfIP-1A-31 Polypeptide and FGTW-52 Polypeptide in WCRW Assay The AfIP-1A-31 protein was combined with FGTW-52 protein to determine if the binary pairs could be exchanged and maintain insecticidal activity in the WCRW assay. Crude lysates from *E. coli* expressing FGTW-51 (total protein concentration=79 mg/mL) or FGTW-52 (total protein concentration=64 mg/mL) were used for this experiment and combined with 0.2 mg/mL purified AfIP-1A-31 or AfIP-1B-32. Table 23 shows that the AfIP-1A-31 and FGTW-52 proteins together maintained insecticidal activity.

TABLE 23

| | Rep 1 | Rep 2 | Rep 3 | Rep 4 | Rep 5 | Rep 6 | Ave |
|---|---|---|---|---|---|---|---|
| Buffer control | 0 | 0 | 0 | 0 | 0 | 0 | 0.0 |
| 200 ppm AfIP-1A-31 | 0 | 0 | 0 | 0 | 0 | 0 | 0.0 |
| 200 ppm AfIP-1B-32 | 0 | 0 | 0 | 0 | 0 | 0 | 0.0 |
| 200 ppm AfIP-1A-31 + 200 ppm AfIP-1B-32 | 3 | 2 | 2 | 3 | 3 | 2 | 2.5 |
| FGTW-51 | 0 | 0 | 0 | 0 | 0 | 0 | 0.0 |
| FGTW-52 | 0 | 0 | 0 | 0 | 0 | 0 | 0.0 |
| FGTW-51 + FGTW-52 | 2 | 2 | 2 | 2 | 3 | 3 | 2.3 |
| ½X FGTW-51 + ½X FGTW-52 | 2 | 3 | 2 | 2 | 2 | 2 | 2.2 |
| ¼X FGTW-51 + ¼X FGTW-52 | 2 | 1 | 2 | 1 | 2 | 1 | 1.5 |
| FGTW-52 + 200 ppm AfIP-1A-31 | 1 | 1 | 1 | 1 | 2 | 1 | 1.2 |
| ½X FGTW-52 + 200 ppm AfIP-1A-31 | 0 | 1 | 1 | 1 | 0 | 0 | 0.5 |
| ¼X FGTW-52 + 200 ppm AfIP-1A-31 | 0 | 0 | 0 | 0 | 0 | 0 | 0.0 |

Example 19

AfIP-1A-31 polypeptide/AfIP-1B-32 Polypeptide Sequential Feeding in WCRW Assay

To determine if the presence of both proteins simultaneously is required for WCRW insecticidal activity, second instar larvae were placed on rootworm diet containing 150 ppm AfIP-1A-31 or 150 ppm AfIP-1B-32 or 150 ppm AfIP-1A-31 plus 150 ppm AfIP-1B-32 (positive control) or no insecticidal protein (negative control). After 24 hour exposure all larvae were transferred to diet containing no toxin for 24 hrs. Larvae that had previously been exposed to AfIP-1A-31 only were then transferred to diet containing 150 ppm AfIP-1B-32 for an additional 24 hrs. Those that had been exposed to AfIP-1B-32 only on Day 1 were transferred to diet containing 150 ppm AfIP-1A-31 after Day 2. Positive and negative control larvae were kept on diet without insecticidal protein. The growth of the larvae was scored 72 hours after the start of the experiment. The results summarized in Table 24 demonstrate that there is a durable interaction of AfIP-1B-32 with its target in WCRW. Surprisingly the results indicate that simultaneous presence of both proteins is not needed for toxicity to WCRW larvae.

TABLE 24

| Exposure | | | |
|---|---|---|---|
| Day 1 | Day 2 | Day 3 | Mean WCRW Score |
| AfI P-1A-31 + AfIP-1B-32 | untreated diet | untreated diet | 2.2 |
| AfIP-1A-31 | untreated diet | untreated diet | 0.1 |
| AfI P-1B-32 | untreated diet | untreated diet | 0.5 |
| AfIP-1A-31 | untreated diet | AfI P-1B-32 | 0.2 |
| AfI P-1B-32 | untreated diet | AfIP-1A-31 | 1.5 |
| untreated diet | untreated diet | untreated diet | 0 |

Example 20

AfIP-1A-31 Polypeptide/AfIP-1B-32 Fusion Protein Constructs

*E. coli* pBET24 based expression vectors were constructed comprising: a nucleic acid molecule (SEQ ID NO: 1) encoding AfIP-1A-31 (SEQ ID NO: 2); a nucleic acid molecule encoding a protein linker (Table 25) and a nucleic acid molecule (SEQ ID NO: 3) encoding AfIP-1B-32 (minus the N-terminal methionine of SEQ ID NO: 4) or a nucleic acid molecule (SEQ ID NO: 25) encoding AfIP-1B-32 with a poly His-Tag (minus the N-terminal methionine of SEQ ID NO: 26); which encode the fusion proteins as indicated in Table 25. The fusion proteins of Table 25 were expressed in *E. coli* and cleared lysates were found to have insecticidal activity.

TABLE 25

| Fusion Protein SEQ ID NO: | Protein 1 | Linker Sequence | Protein 2 |
|---|---|---|---|
| G7014 SEQ ID NO: 102 | AfIP-1A-31 | LEGGGASGGGASGGGASH SEQ ID NO: 113 | AfIP-1B-32 |
| G7015 SEQ ID NO: 104 | AfIP-1A-31 | LEGGGA**SLSQSLSQS**GGGASH SEQ ID NO: 114 | AfIP-1B-32 |
| G7016 SEQ ID NO: 106 | AfIP-1A-31 | LEGGGASGGGASGGGASGGGASGGGASGGGASH SEQ ID NO: 115 | AfIP-1B-32 |
| G7017 SEQ ID NO: 108 | AfIP-1A-31 | LEGGGASGGGASGGGA**SLSQSLSQS**GGGASGGGASGGGASH SEQ ID NO: 116 | AfIP-1B-32 |
| G7018 SEQ ID NO: 110 | AfIP-1A-31 | LEGGGASGGGASGGGASH SEQ ID NO: 117 | AfIP-1B-32-6XHis |
| G7019 SEQ ID NO: 112 | AfIP-1A-31 | LEGGGASGGGASGGGA**SLSQSLSQS**GGGASGGGASGGGASH SEQ ID NO: 118 | AfIP-1B-32-6XHis |

Example 21

Figure 9:
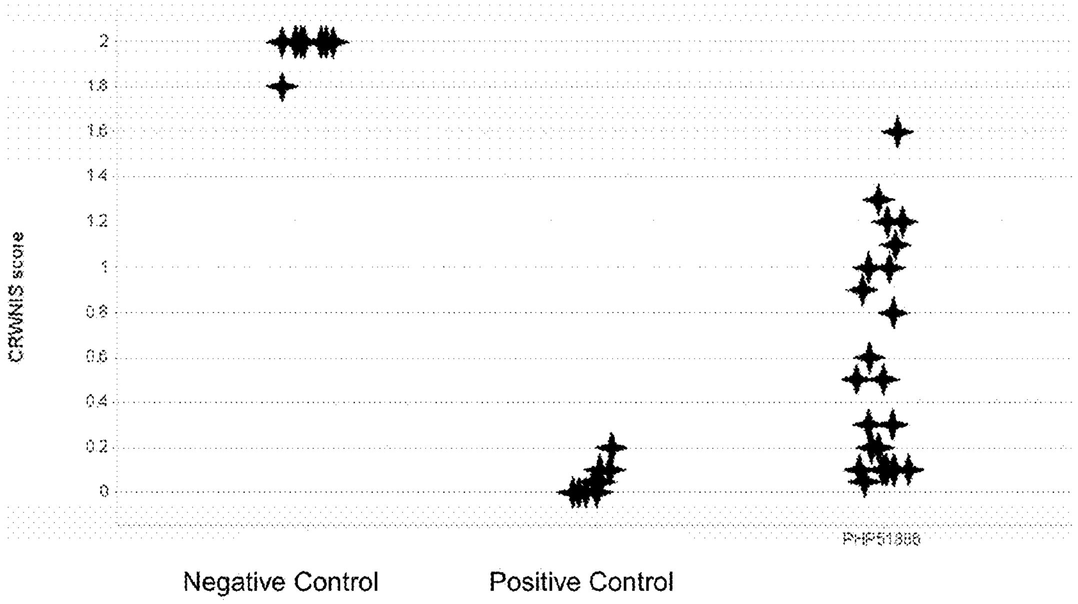
FIG. 9 shows the greenhouse efficacy test results for PHP51688 $T_0$ plants. The Y-axis 'Score' represents the Corn rootworm nodal injury score (CRWNIS) where 0 is no injury, 2 is two nodes damaged.
Figure 10:
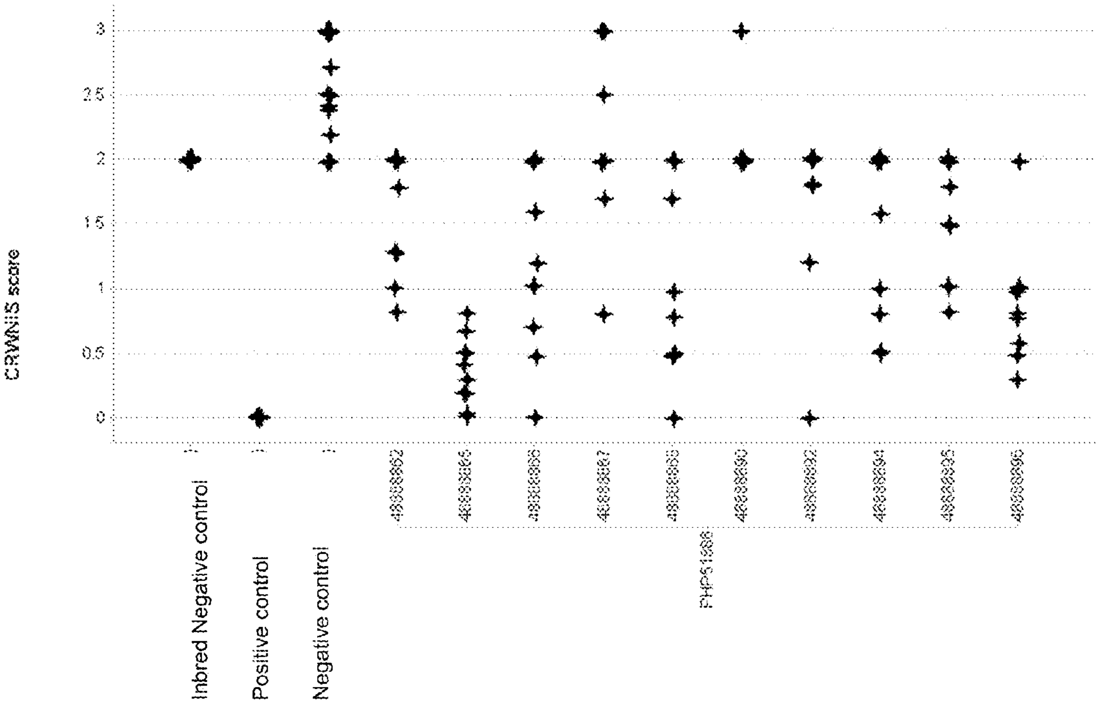
FIG. 10 shows the PHP51688 $T_1$ event results. The Y-axis 'Score' represents the Corn rootworm nodal injury score (CRWNIS) where 0 is no injury, 2 is two nodes damaged.

Expression Vector Construct for Co-Expression of AfIP-1A-31 and AfIP-1B-32 in Plants The plant expression vector, PHP51886, was constructed including a first transgene cassette comprising a nucleic acid molecule which includes the maize methallothionein (RM2) promoter (U.S. Pat. No. 7,214,854) operably linked to a nucleic acid molecule encoding the AfIP-1A-31 polypeptide variant of SEQ ID NO: 94 and a second transgene cassette comprising a nucleic acid molecule which includes the promoter, 5' untranslated exon and first intron of the maize ubiquitin (Ubi-1) gene (Christensen, et al., (1992) *Plant Mol. Biol.* 18:675-689 and Christensen and Quail, (1996) *Transgenic Res.* 5:213-218) operably connected to a nucleic acid molecule encoding the AfIP-1B-32 polypeptide variant of SEQ ID NO: 76. FIG. 9 shows the greenhouse efficacy test results for PHP51688 $T_0$ plants. The Y-axis 'Score' represents the Corn rootworm nodal injury score (CRWNIS) where 0 is no injury, 2 is two nodes damaged. FIG. 10 shows the PHP51688 $T_1$ event results.

Example 22

Figure 11:
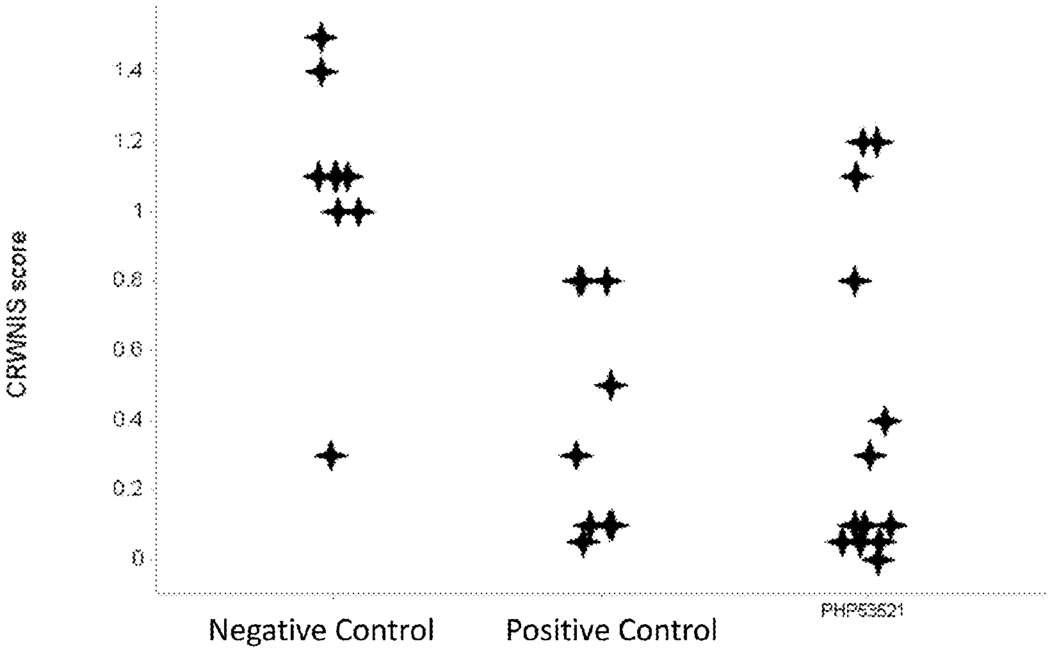
FIG. 11 shows the greenhouse efficacy test results for PHP53521 $T_0$ plants. The Y-axis 'Score' represents the Corn rootworm nodal injury score (CRWNIS) where 0 is no injury, 2 is two nodes damaged.

Expression Vector Construction for Expression of AfIP-1A-31/AfIP-1B-32 Fusion Protein in Plants The plant expression vector, PHP53521, was constructed including a transgene cassette comprising a nucleic acid molecule (SEQ ID NO: 253) which includes the promoter, 5' untranslated exon, and first intron of the maize ubiquitin (Ubi-1) gene (Christensen, et al., (1992) *Plant Mol. Biol.* 18:675-689 and Christensen and Quail, (1996) *Transgenic Res.* 5:213-218) operably linked to a nucleic acid molecule encoding AfIP-1B-32 variant of SEQ ID NO: 76, the MultiGene Expression Vehicle (MGEV) linker (Glu Glu Lys Lys Asn (SEQ ID NO: 153)) and AfIP-1A-31 variant of SEQ ID NO: 94 (minus the N-terminal Met) fused in-frame, which encodes the AfIP-1A-31/AfIP-1B-32 fusion protein of SEQ ID NO: 254. FIG. 11 shows the greenhouse efficacy test results for PHP53521 $T_0$ plants. The Y-axis 'Score' represents the Corn rootworm nodal injury score (CRWNIS) where 0 is no injury, 2 is two nodes damaged.

Example 23

Variants of AfIP-1A-31 with Modified Physical Properties

To identify AfIP-1A-31 variants with modified physical properties a series of variants were created by site directed mutagenesis using a Phusion® High-Fidelity PCR Kit (New England Biolabs®, Catalog #E0553S) according to the manufacturer's directions. Briefly, the double-stranded DNA template is denatured at a high temperature, and then sequence-specific primers are annealed to sites flanking the target sequence and extended by Thermo Scientific® Phusion® High-Fidelity DNA polymerase. This newly synthesized product then becomes an additional template for subsequent cycles of amplification using a resolution primer. AfIP-1A-31 variants with the following single amino acid substitutions were generated as described above: G47L, G47F, D48L, D48F, K49L, K49F, D50L, D50F, K51L, K51F, E52L, E52F, 153L, 153F, S54L, S54F, P55L, P55F, S56L, Q57L, Q57F, 158L, 158F, N59L, N59F, G60L, G60F, T61L, T61F, 162L, 162F, K64L, K64F, D565L, D65F, Y121L, Y121F, Y122L, T122F, V123L, V123F, V123N, I124L, I124F, K125L, K125F, K125M, K126L, K126F, G1271, G127F, G128L, G128F, G129L, G129F, S130L, and S130F. The resulting AfIP-1A-31 variants were expressed in *E. coli* as His tagged proteins and screened as cleared lysates for WCRW insecticidal activity. The resulting AfIP-1A-31 variants were found to have WCRW insecticidal activity greater than 10 on a scale of 18 with the exception of N59L, N59F, G127L, and G127P. The AfIP-1A-31 variants identified in Table 26 were selected to further test the physical properties of the resulting AfIP-1A polypeptides. Table 26 shows the amino acid substitution, the mutagenesis primer used in the first PCR reaction, and the polynucleotide sequence encoding the respective AfIP-1A polypeptide.

TABLE 26

| variant | a.a. substitution compared to SEQ ID ID: 2 | Mutagenesis primers | Polypeptide SEQ ID NO: | Polynucleotide SEQ ID NO: |
|---|---|---|---|---|
| AfIP-1A-31-K49F | K49F | SEQ ID NO: 731<br>SEQ ID NO: 732<br>SEQ ID NO: 733 | SEQ ID NO: 301 | SEQ ID NO: 312 |
| AfIP-1A-31-K49L | K49L | SEQ ID NO: 731<br>SEQ ID NO: 732<br>SEQ ID NO: 733 | SEQ ID NO: 302 | SEQ ID NO: 313 |
| AfIP-1A-31-D50F | D50F | SEQ ID NO: 731<br>SEQ ID NO: 732<br>SEQ ID NO: 734 | SEQ ID NO: 303 | SEQ ID NO: 314 |
| AfIP-1A-31-D50L | D50L | SEQ ID NO: 731<br>SEQ ID NO: 732<br>SEQ ID NO: 734 | SEQ ID NO: 304 | SEQ ID NO: 315 |
| AfIP-1A-31-K51F | K51F | SEQ ID NO: 735<br>SEQ ID NO: 736<br>SEQ ID NO: 737 | SEQ ID NO: 305 | SEQ ID NO: 316 |
| AfIP-1A-31-K51L | K51L | SEQ ID NO: 735<br>SEQ ID NO: 736<br>SEQ ID NO: 737 | SEQ ID NO: 306 | SEQ ID NO: 317 |
| AfIP-1A-31-E52L | E52L | SEQ ID NO: 738<br>SEQ ID NO: 739<br>SEQ ID NO: 740 | SEQ ID NO: 307 | SEQ ID NO: 318 |
| AfIP-1A-31-S54F | S54F | SEQ ID NO: 741<br>SEQ ID NO: 742<br>SEQ ID NO: 743 | SEQ ID NO: 308 | SEQ ID NO: 319 |
| AfIP-1A-31-S54L | S54L | SEQ ID NO: 741<br>SEQ ID NO: 742<br>SEQ ID NO: 743 | SEQ ID NO: 309 | SEQ ID NO: 320 |
| AfIP-1A-31-P55F | P55F | SEQ ID NO: 744<br>SEQ ID NO: 745<br>SEQ ID NO: 746 | SEQ ID NO: 310 | SEQ ID NO: 321 |
| AfIP-1A-31-P55L | P55L | SEQ ID NO: 744<br>SEQ ID NO: 745<br>SEQ ID NO: 746 | SEQ ID NO: 311 | SEQ ID NO: 322 |

Example 24

Variants of AfIIP-1B-32 with Modified Physical Properties

A series of AfIP-1B-32 variants with modified physical properties were created by mutagenesis methods as described previously in Example 9. Briefly, oligonucleotides (Table 27) were designed to introduce the following mutations: 134L, 138L, 143L, Y53F, Y55F, V86L, Y94F, 197L, Y101F, I103L, I106L, I109L, I181L, V188L, W201F, Y203F, 1214L, I220L, Y224F, V235L, Y414F, I418L, V423L, V526L, I530L, 1536L, Y538F, Y543F, Y547F, Y550F, Y625F, I631L, and W633F compared to SEQ ID NO: 4 (AfIP-1B-32). Four individual libraries were constructed by mixing fragmented AfIP-1B-32 gene (SEQ ID NO: 4) fragments with pooled oligos in a ratio of 15:1, 10:1, 7.5:1 and 3.75:1, and the full length genes were assembled by PCR reactions (Statzman-Engwall, et al., (2005) *Metabolic Engineering* 7:27-37. The four libraries were expressed in *E. coli* and about 1500 isolates were screened as cleared lysates for WCRW insecticidal activity as described previously in Example 1. Isolates with WCRW insecticidal activity greater than 10 on a scale of 18 were sequenced to determine the identity of the amino acid changes (Table 28). In addition to the above identified designed amino acid substitutions the following random amino acid changes, S134L, K196E, I270V, K296E, E367K, G368D, R373S, A398V, E425V, 1427V, M434T, N5125, V533A, K544R, F558L, M600V, D607G, 1612T, L613P, N615D, Q646R, N661S, 5700G, and F702S compared to SEQ ID NO: 4 (AfIP-1B-32), were also identified in some of the variants. None of the active variants sequenced contained the designed amino acid substitutions 134L and 143L.

TABLE 27

| | Oligo sequence |
|---|---|
| 32-SGF 01 | CAGTTCTGATAAATCCACTTACCAGAATGATTACCCA SEQ ID NO: 459 |
| 32-SGF 02 | ATCCAATTACCAGAATGCTTACCCAAAAAGAAATTG SEQ ID NO: 460 |
| 32-SGF 03 | GAATGATTACCCAAAAAGAACTTGAAATGGGTATGAG SEQ ID NO: 461 |
| 32-SGF 04 | GAGTGGTAAAAGCCAATTTGTCTACACTGACTCCTTG SEQ ID NO: 462 |
| 32-SGF 05 | GGTAAAAGCCAATATGTCTTCACTGACTCCTTGAACG SEQ ID NO: 463 |
| 32-SGF 06 | CTGCAGTTGCTGTATCCCTCAGCAATGCAACTGCTTC SEQ ID NO: 464 |
| 32-SGF 07 | TGCAACTGCTTCGGAGTTCAAGTCTATAAAAGTCTCC SEQ ID NO: 465 |
| 32-SGF 08 | CTTCGGAGTACAAGTCTCTAAAAGTCTCCTACAATAT SEQ ID NO: 466 |
| 32-SGF 09 | CTATAAAAGTCTCCTTCAATATTTCCATGATCTCGGGA SEQ ID NO: 467 |
| 32-SGF 10 | GTCTCCTACAATCTTTCCATGATCTCGGGAATAGAATA SEQ ID NO: 468 |
| 32-SGF 11 | CTCCTACAATATTTCCATGCTCTCGGGAATAGAATAT SEQ ID NO: 469 |
| 32-SGF 12 | ATTTCCATGATCTCGGGACTAGAATATATCGACTTTGAC SEQ ID NO: 470 |
| 32-SGF 13 | GTCTGGTCGTGGGAGCCCTCTGGGGTGGAATGGGCTC SEQ ID NO: 471 |
| 32-SGF 14 | GGTGGAATGGGCTCTCTTTCTACGGAGATGACGAGC SEQ ID NO: 472 |
| 32-SGF 15 | AAAACAGAAGACAGCTTTAAGTATGGAGAAACGGCTGAAT SEQ ID NO: 473 |
| 32-SGF 16 | ACAGAAGACAGCTGGAAGTTTGGAGAAACGGCTGAATTC SEQ ID NO: 474 |
| 32-SGF 17 | GAATTCAGCTATTCAGGGCTAGGAAGTTCCGTATCC SEQ ID NO: 475 |
| 32-SGF 18 | GATAGGAAGTTCCGTATCCCTAGCGCAAACCTATAATGG SEQ ID NO: 476 |
| 32-SGF 19 | CGTATCCATAGCGCAAACCTTTAATGGATCTCAAAAAG SEQ ID NO: 477 |
| 32-SGF 20 | GATCAAAGCTCTGAACTTGAGGTATCTTGCAAGGCTC SEQ ID NO: 478 |
| 32-SGF 21 | ATGGATGTCGATGGGATTCATGAACGAAATCAGTGATGC SEQ ID NO: 479 |
| 32-SGF 22 | GATGGGATACATGAACGAACTCAGTGATGCTGAGGTTGC SEQ ID NO: 480 |
| 32-SGF 23 | GAAATCAGTGATGCTGAGCTTGCGGAGTACATCCTG SEQ ID NO: 481 |
| 32-SGF 24 | CTCATTGGGGATCAGTCACTAAGCAGTGAAATTATC SEQ ID NO: 482 |
| 32-SGF 25 | GTCAGTAAGCAGTGAACTTATCGACGTTAAGCCG SEQ ID NO: 483 |
| 32-SGF 26 | ATCGACGTTAAGCCGCTACCGTATCCCGAGGTCAC SEQ ID NO: 484 |
| 32-SGF 27 | TTAAGCCGATACCGTTTCCCGAGGTCACCTACAAGGC SEQ ID NO: 485 |
| 32-SGF 28 | TATCCCGAGGTCACCTTCAAGGCAGCTTATTGCAGC SEQ ID NO: 486 |
| 32-SGF 29 | TCACCTACAAGGCAGCTTTTTGCAGCTATGGAAACAAC SEQ ID NO: 487 |
| 32-SGF 30 | AGGCAGCTTATTGCAGCTTTGGAAACAACAACCCGAC SEQ ID NO: 488 |
| 32-SGF 31 | GTTGATACCTATTCCATTCTCTGCCGCCAAGGGAATT SEQ ID NO: 489 |
| 32-SGF 32 | CTGCCGCCAAGGGACTTCAATGGCGGGGGCAAGGCCA SEQ ID NO: 490 |
| 32-SGF 33 | CGCCAAGGGAATTCAATTTCGGGGGCAAGGCCAAGGT SEQ ID NO: 491 |
| 32-SGF 34 | GAGTGGTAAAAGCCAATWTGTCTWCACTGACTCCTTGA SEQ ID NO: 492 |
| 32-SGF 35 | GCTTCGGAGTWCAAGTCTMTAAAAGTCTCCTWCAATMTTTCCATG SEQ ID NO: 493 |
| 32-SGF 36 | AAAAGTCTCCTWCAATMTTTCCATGMTCTCGGGAMTAGAATATATCG SEQ ID NO: 494 |
| 32-SGF 37 | AACAGAAGACAGCTTTAAGTWTGGAGAAACGGCTGA SEQ ID NO: 495 |
| 32-SGF 38 | GTTCCGTATCCMTAGCGCAAACCTWTAATGGATCTCAA SEQ ID NO: 496 |
| 32-SGF 39 | TTCATGAACGAAMTCAGTGATGCTGAGCTTGCGG SEQ ID NO: 497 |

TABLE 27-continued

| | Oligo sequence |
|---|---|
| 32-SGF 40 | GATCAGTCASTAAGCAGTGAAMTTATCGACGTTAAGC SEQ ID NO: 498 |
| 32-SGF 41 | ATCGACGTTAAGCCGMTACCGTWTCCCGAGGTCACC SEQ ID NO: 499 |
| 32-SGF 42 | CGAGGTCACCTWCAAGGCAGCTTWTTGCAGCTWTGGAAACAACA SEQ ID NO: 500 |
| 32-SGF 43 | GGTCACCTWCAAGGCAGCTTWTTGCAGCTWTGGAAACAACA SEQ ID NO: 501 |

TABLE 28

| variant | Substitutions compared to SEQ ID NO: 2 | Polypeptide | Polynucleotide |
|---|---|---|---|
| 32shuf11r-01 | K196E, Y224F, I418L, V526L, I536L, K544R, D607G, F702S | SEQ ID NO: 323 | SEQ ID NO: 391 |
| 32shuf11r-02 | V235L, V533A, I536L, Y625F | SEQ ID NO: 324 | SEQ ID NO: 392 |
| 32shuf11r-03 | I38L, Y53F, Y94F, I103L, I181L, V235L, Y414F, V526L, I536L | SEQ ID NO: 325 | SEQ ID NO: 393 |
| 32shuf11r-06 | I103L, I109L, W201F, Y414F, I427V, V526L | SEQ ID NO: 326 | SEQ ID NO: 394 |
| 32shuf11r-07 | I181L, Y414F, V423L, I536L | SEQ ID NO: 327 | SEQ ID NO: 395 |
| 32shuf11r-09 | V235L, I530L, Y538F, Y625F | SEQ ID NO: 328 | SEQ ID NO: 396 |
| 32shuf11r-11 | W201F, V235L, I536L, Y538F | SEQ ID NO: 329 | SEQ ID NO: 397 |
| 32shuf11r-14 | I109L, Y203F, Y414F, I530L | SEQ ID NO: 330 | SEQ ID NO: 398 |
| 32shuf11r-17 | I181L, Y414F, V526L, I536L, Y538F, Y547F, Y625F | SEQ ID NO: 331 | SEQ ID NO: 399 |
| 32shuf11r-18 | I530L, Y538F, Y547F, I631L | SEQ ID NO: 332 | SEQ ID NO: 400 |
| 32shuf11r-20 | V86L, W201F, I214L, V423L, Y538F | SEQ ID NO: 333 | SEQ ID NO: 401 |
| 32shuf11r-22 | W201F, I220L, Y224F, Y414F, I418L, V526L, Y538F | SEQ ID NO: 334 | SEQ ID NO: 402 |
| 32shuf11r-24 | Y101F, I103L, I106L, I418L | SEQ ID NO: 335 | SEQ ID NO: 403 |
| 32shuf11r-28 | I106L, Y414F,I536L, Y543F, Y550F | SEQ ID NO: 336 | SEQ ID NO: 404 |
| 32shuf11r-35 | I103L, I214L, A398V, I418L, I530L, Y538F | SEQ ID NO: 337 | SEQ ID NO: 405 |
| 32shuf11r-38 | V235L, Y414F, I530L, I536L | SEQ ID NO: 338 | SEQ ID NO: 406 |
| 32shuf11r-40 | I220L, Y224F,I418L, I530L, I536L, Y547F, I631L | SEQ ID NO: 339 | SEQ ID NO: 407 |
| 32shuf11r-42 | Y94F, Y101F, W201F, I214L, I220L, Y414F | SEQ ID NO: 340 | SEQ ID NO: 408 |
| 32shuf11r-46 | 1220L, Y414F, E425V, Y538F, Y547F, Y550F | SEQ ID NO: 341 | SEQ ID NO: 409 |
| 32shuf11r-48 | 197L, I214L, V235L, Y414F, Y550F | SEQ ID NO: 342 | SEQ ID NO: 410 |
| 32shuf11r-58 | Y101F, I103L, Y224F, Y414F | SEQ ID NO: 343 | SEQ ID NO: 411 |
| 32shuf11r-59 | Y101F, I106L, I181L, I214L, G368D, Y538F, F558L, W633F | SEQ ID NO: 344 | SEQ ID NO: 412 |
| 32shuf11r-64 | Y53F, Y94F, Y101F, I109L, I181L, K296E, E367K, V423L, I536L | SEQ ID NO: 345 | SEQ ID NO: 413 |
| 32shuf11r-65 | I106L, V188L, M434T, I530L, Y550F, Y625F | SEQ ID NO: 346 | SEQ ID NO: 414 |
| 32shuf11r-66 | I181L, W201F, Y543F, Y550F, I631L | SEQ ID NO: 347 | SEQ ID NO: 415 |
| 32shuf11r-68 | I214L, Y538F, M600V, L613P | SEQ ID NO: 348 | SEQ ID NO: 416 |
| 32shuf11r-71 | I103L, I109L, Y547F, Y625F | SEQ ID NO: 349 | SEQ ID NO: 417 |
| 32shuf11r-73 | Y101F, V235L, I530L, I631L | SEQ ID NO: 350 | SEQ ID NO: 418 |
| 32shuf11r-77 | Y55F, Y203F, V235L, I536L | SEQ ID NO: 351 | SEQ ID NO: 419 |
| 32shuf11r-79 | I97L, Y101F, I220L, Y414F, V526L, Y625F | SEQ ID NO: 352 | SEQ ID NO: 420 |
| 32shuf12r-01 | I214L, Y414F, V423L, I530L, Y538F, Y550F, I631L, Q646R | SEQ ID NO: 353 | SEQ ID NO: 421 |
| 32shuf12r-03 | V526L, Y538F, Y625F, W633F | SEQ ID NO: 354 | SEQ ID NO: 422 |
| 32shuf12r-05 | I103L, S134L, V188L, I214L, Y543F, 1631L | SEQ ID NO: 355 | SEQ ID NO: 423 |
| 32shuf12r-06 | I109L, I220L, Y224F, I418L, Y538F, I612T, I631L | SEQ ID NO: 356 | SEQ ID NO: 424 |
| 32shuf12r-07 | Y94F, Y101F, I109L, I418L, V423L, V526L, I536L, Y550F | SEQ ID NO: 357 | SEQ ID NO: 425 |
| 32shuf12r-08 | Y101F, I109L, Y414F, Y543F | SEQ ID NO: 358 | SEQ ID NO: 426 |
| 32shuf12r-10 | I181L, I418L, Y550F, W633F | SEQ ID NO: 359 | SEQ ID NO: 427 |
| 32shuf12r-11 | V188L, I214L, V235L, I530L, Y543F, Y547F | SEQ ID NO: 360 | SEQ ID NO: 428 |

TABLE 28-continued

| variant | Substitutions compared to SEQ ID NO: 2 | Polypeptide | Polynucleotide |
|---|---|---|---|
| 32shufl2r-12 | I214L, V235L, I418L, I536L, Y550F | SEQ ID NO: 361 | SEQ ID NO: 429 |
| 32shufl2r-16 | V188L, Y224F, V235L, N512S, I530L, Y625F | SEQ ID NO: 362 | SEQ ID NO: 430 |
| 32shufl2r-17 | Y224F, I270L, Y547F, Y625F | SEQ ID NO: 363 | SEQ ID NO: 431 |
| 32shufl2r-58 | I109L, I181L, Y203F, Y414F, Y625F | SEQ ID NO: 364 | SEQ ID NO: 432 |
| 32shufl2r-68 | I220L, I530L, Y538F, Y543F | SEQ ID NO: 365 | SEQ ID NO: 433 |
| 32shufl2r-84 | Y53F, I103L, I181L, Y414F, 1530L | SEQ ID NO: 366 | SEQ ID NO: 434 |
| 32shufl2r-85 | I109L, W201F,V235L,I418L, V423L, Y538F, I631L | SEQ ID NO: 367 | SEQ ID NO: 435 |
| 32shufl2r-88 | I109L, V188L, Y224F, Y414F, 1530L, Y547F, Y625F | SEQ ID NO: 368 | SEQ ID NO: 436 |
| 32shufl2r-90 | I103L, W201F, I536L, Y538F, Y543F, Y550F | SEQ ID NO: 369 | SEQ ID NO: 437 |
| 32shufl2r-92 | I214L, V423L, V526L, N615D, Y625F | SEQ ID NO: 370 | SEQ ID NO: 438 |
| 32shufl2r-95 | I181L, I214L, V235L, I418L, V423L, I536L, Y538F, M563V | SEQ ID NO: 371 | SEQ ID NO: 439 |
| 32shufl1r-08 | W201F, S700G | SEQ ID NO: 372 | SEQ ID NO: 440 |
| 32shufl1r-13 | I214L, Y538F | SEQ ID NO: 373 | SEQ ID NO: 441 |
| 32shufl1r-19 | Y543F, I631L | SEQ ID NO: 374 | SEQ ID NO: 442 |
| 32shufl1r-25 | I181L, V423L, I631L | SEQ ID NO: 375 | SEQ ID NO: 443 |
| 32shufl1r-44 | V188L, Y625F, N661S | SEQ ID NO: 376 | SEQ ID NO: 444 |
| 32shufl1r-56 | Y414F, Y550F | SEQ ID NO: 377 | SEQ ID NO: 445 |
| 32shufl1r-61 | Y55F, I536L, W633F | SEQ ID NO: 378 | SEQ ID NO: 446 |
| 32shufl2r-04 | Y224F, I418L | SEQ ID NO: 379 | SEQ ID NO: 447 |
| 32shufl2r-09 | R373S, I530L, Y625F | SEQ ID NO: 380 | SEQ ID NO: 448 |
| 32shufl2r-15 | 1530L, Y543F, Y550F | SEQ ID NO: 381 | SEQ ID NO: 449 |
| 32shufl2r-19 | V423L, Y550F | SEQ ID NO: 382 | SEQ ID NO: 450 |
| 32shufl2r-28 | I214L, V235L | SEQ ID NO: 383 | SEQ ID NO: 451 |
| 32shufl2r-35 | I418L, I536L | SEQ ID NO: 384 | SEQ ID NO: 452 |
| 32shufl2r-45 | I530L, Y538F, Y547F | SEQ ID NO: 385 | SEQ ID NO: 453 |
| 32shufl2r-91 | I106L, W201L, V235L | SEQ ID NO: 386 | SEQ ID NO: 454 |
| 32shufl2r-96 | W201F, I530L | SEQ ID NO: 387 | SEQ ID NO: 455 |
| 32shufl3r-21 | Y224F, I530L, Y538F | SEQ ID NO: 388 | SEQ ID NO: 456 |
| 32shufl3r-92 | Y101F, V235L,I530L,I631L | SEQ ID NO: 389 | SEQ ID NO: 457 |
| 32shufl4r-01 | I536L, Y547F, Y625F | SEQ ID NO: 390 | SEQ ID NO: 458 |

Example 25

Variants of AfIP-1A-31 with Multiple Amino Acid Substitutions in Motif 2

Figure 12:
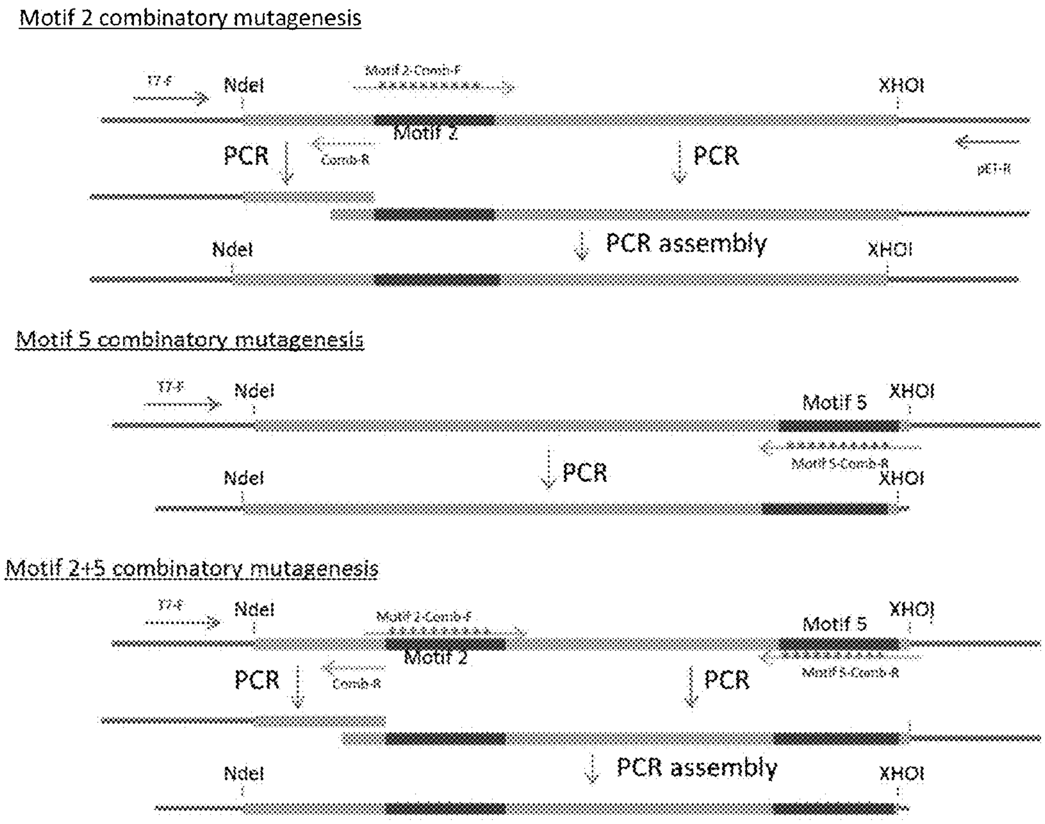
FIG. 12 shows the PCR mutagenesis strategy used to generate variants of AfIP-1A-31 with multiple amino acid substitutions in motif 2 (Example 25), variants of AfIP-1A-31 with multiple amino acid substitutions in motif 5 (Example 26), and variants of AfIP-1A-31 with multiple amino acid substitutions in motif 2 and motif 5 (Example 27).

AfIP-1A-31 variants with multiple selected amino acid substitutions in motif 2 were generated using the mutagenesis primer Motif 2-Comb-R (ACCTTCTACTTTGAAGTTTGAGTTA SEQ ID NO: 382) paired with the mutagenesis primer T7-F (TAATACGACTCACTATAGGG SEQ ID NO: 683) and the mutagenesis primer pETR (ATCCGGATATAGTTCCTCCTTTCAG SEQ ID NO: 684) paired with the degenerate mutagenesis primer Motif 2-Comb-F (TAACTCAAACTTCAAAGTAGAAGGTDCGTWCVTSARGTGGGGAAAGTTCCATVTSSCCGGAGAT AAAGACAAGGAAATAAGTCC SEQ ID NO: 685) using sewing and rescuing PCR strategy of two overlapping fragments of N-terminus (no mutation) and C-terminus (with mutations) as illustrated in FIG. 12.

The mutagenesis primer Motif 2-Comb-F (SEQ ID NO: 685) was designed to be partially degenerate at residues 36, 37, 38, 39, 45, and 46 of motif 2 corresponding to SEQ ID NO: 2 (AfIP-1A-31) resulting in selected amino acid substitutions at each residues. Table 29 shows the codon for each residue at position 36-46 relative to SEQ ID NO: 2 and the possible resulting amino acids. In Table 29 the native amino acid is indicated in bold and underlining.

The rescued mutant libraries were cloned into an *E. coli* expression vector, 384 individual isolates were expressed in *E. coli*, and cell lysates screened in the WCRW insecticidal assay as described previously. The respective isolates having a score of 10 or greater out of 18 in the WCRW screen were DNA sequenced to determine the amino acid sequence of the variant polypeptides. Table 30 shows for each AfIP-1A-31 variant the amino acid substitutions identified in motif 2 (a.a. 36-46), and those substitutions that were active in the WCRW insecticidal assay a minimal score of 10 or greater out of 18. In Table 30 the amino acid substitutions in motif 2 compared to AfIP-1A-31 (SEQ ID NO: 2) are indicated in bold and underlining.

TABLE 29

| AfIP-1A-31 SEQ ID NO: 2 Residue # | codon | Degeneracy | Resulting amino acids* |
|---|---|---|---|
| 36 | **D**CG | D = A, G or T | **Ala**, Ser, and Thr |
| 37 | T**W**C | W = A or T | **Tyr** and Phe |
| 38 | **V**T**S** | V = A, G or C<br>S = C or G | **Leu**, Met, Ile, and Val |
| 39 | A**R**G | R = A or G | **Arg** and Lys |
| 40 | TGG | none | **Trp** |
| 41 | GGA | none | **Gly** |
| 42 | AAG | none | **Lys** |
| 43 | TTT | none | **Phe** |
| 44 | CAT | none | **His** |
| 45 | **V**T**S** | V = A, G or C<br>S = C or G | **Val**, Leu, Met, and Ile |
| 46 | **S**CC | S = C or G | **Pro** and Ala |

TABLE 30

| AfIP-1A-31 Variant | Motif 2 sequence | Number of substitutions | Polynucleotide sequence |
|---|---|---|---|
| AfIP-1A-31 SEQ ID NO: 2 | AYLRWGKFHVP a.a. 36-46 of SEQ ID NO: 2 | | SEQ ID NO: 3 |
| Motif 2-3B3 SEQ ID NO: 502 | AYLRWGKFHV**A** a.a. 36-46 of SEQ ID NO: 502 | 1 | SEQ ID NO: 546 |
| Motif 2-3H6 SEQ ID NO: 503 | AYL**K**WGKFHV**A** a.a. 36-46 of SEQ ID NO: 503 | 2 | SEQ ID NO: 547 |
| Motif 2-3G1 SEQ ID NO: 504 | AY**V**RWGKFHV**A** a.a. 36-46 of SEQ ID NO: 504 | 2 | SEQ ID NO: 548 |
| Motif 2-3F5 SEQ ID NO: 505 | AY**MK**WGKFH**LA** a.a. 36-46 of SEQ ID NO: 505 | 4 | SEQ ID NO: 549 |
| Motif 2-3F8 SEQ ID NO: 506 | AY**M**RWGKFH**MA** a.a. 36-46 of SEQ ID NO: 506 | 3 | SEQ ID NO: 550 |
| Motif 2-3A8 SEQ ID NO: 507 | AY**V**RWGKFH**LA** a.a. 36-46 of SEQ ID NO: 507 | 3 | SEQ ID NO: 551 |
| Motif 2-3B1 SEQ ID NO: 508 | **S**YLRWGKFHV**A** a.a. 36-46 of SEQ ID NO: 508 | 2 | SEQ ID NO: 552 |
| Motif 2-3C1 SEQ ID NO: 509 | **S**Y**V**RWGKFHV**A** a.a. 36-46 of SEQ ID NO: 509 | 3 | SEQ ID NO: 553 |
| Motif 2-3B2 SEQ ID NO: 510 | AY**V**RWGKFHVP a.a. 36-46 of SEQ ID NO: 510 | 1 | SEQ ID NO: 554 |
| Motif 2-3F7 SEQ ID NO: 511 | AY**M**RWGKFHVP a.a. 36-46 of SEQ ID NO: 511 | 1 | SEQ ID NO: 555 |
| Motif 2-3C8 SEQ ID NO: 512 | **S**Y**M**RWGKFHVP a.a. 36-46 of SEQ ID NO: 512 | 2 | SEQ ID NO: 556 |
| Motif 2-3E5 SEQ ID NO: 513 | **S**Y**V**RWGKFH**I**P a.a. 36-46 of SEQ ID NO: 513 | 3 | SEQ ID NO: 557 |
| Motif 2-3A2 SEQ ID NO: 514 | **TF**L**K**WGKFH**MA** a.a. 36-46 of SEQ ID NO: 514 | 5 | SEQ ID NO: 558 |
| Motif 2-3A4 SEQ ID NO: 515 | **S**YL**K**WGKFH**M**P a.a. 36-46 of SEQ ID NO: 515 | 3 | SEQ ID NO: 559 |
| Motif 2-3H5 SEQ ID NO: 516 | **S**YL**K**WGKFH**MA** a.a. 36-46 of SEQ ID NO: 516 | 4 | SEQ ID NO: 560 |
| Motif 2-3F3 SEQ ID NO: 517 | **TF**L**K**WGKFHVP a.a. 36-46 of SEQ ID NO: 517 | 3 | SEQ ID NO: 561 |
| Motif 2-3F4 SEQ ID NO: 518 | **TFIK**WGKFH**I**P a.a. 36-46 of SEQ ID NO: 518 | 5 | SEQ ID NO: 562 |
| Motif 2-3C6 SEQ ID NO: 519 | **SFMK**WGKFH**I**P a.a. 36-46 of SEQ ID NO: 519 | 5 | SEQ ID NO: 563 |
| Motif 2-3D2 SEQ ID NO: 520 | **SFVK**WGKFHVP a.a. 36-46 of SEQ ID NO: 520 | 4 | SEQ ID NO: 564 |
| Motif 2-3H4 SEQ ID NO: 521 | **SFVK**WGKFHV**A** a.a. 36-46 of SEQ ID NO: 521 | 5 | SEQ ID NO: 565 |
| Motif 2-3E4 SEQ ID NO: 522 | A**FVK**WGKFHV**A** a.a. 36-46 of SEQ ID NO: 522 | 4 | SEQ ID NO: 566 |
| Motif 2-3B6 SEQ ID NO: 523 | A**FVK**WGKFHVP a.a. 36-46 of SEQ ID NO: 523 | 3 | SEQ ID NO: 567 |
| Motif 2-3G6 SEQ ID NO: 524 | A**FVK**WGKFH**L**P a.a. 36-46 of SEQ ID NO: 524 | 4 | SEQ ID NO: 568 |
| Motif 2-3E7 SEQ ID NO: 525 | **TFVK**WGKFH**L**P a.a. 36-46 of SEQ ID NO: 525 | 5 | SEQ ID NO: 569 |
| Motif 2-3D7 SEQ ID NO: 526 | **T**Y**VK**WGKFHVP a.a. 36-46 of SEQ ID NO: 526 | 3 | SEQ ID NO: 570 |

TABLE 30-continued

| AfIP-1A-31 Variant | Motif 2 sequence | Number of substitutions | Polynucleotide sequence |
|---|---|---|---|
| Motif 2-3D4 SEQ ID NO: 527 | **SFV**RWGKFHV**A** a.a. 36-46 of SEQ ID NO: 527 | 4 | SEQ ID NO: 571 |
| Motif 2-3F1 SEQ ID NO: 528 | **SFV**RWGKFHVP a.a. 36-46 of SEQ ID NO: 528 | 3 | SEQ ID NO: 572 |
| Motif 2-3H1 SEQ ID NO: 529 | **SF**LRWGKFH**MA** a.a. 36-46 of SEQ ID NO: 529 | 4 | SEQ ID NO: 573 |
| Motif 2-3D5 SEQ ID NO: 530 | **SF**LRWGKFH**LA** a.a. 36-46 of SEQ ID NO: 530 | 4 | SEQ ID NO: 574 |
| Motif 2-3A6 SEQ ID NO: 531 | **SF**IRWGKFHL**A** a.a. 36-46 of SEQ ID NO: 531 | 4 | SEQ ID NO: 575 |
| Motif 2-3E2 SEQ ID NO: 532 | A**F**LRWGKFH**L**P a.a. 36-46 of SEQ ID NO: 532 | 2 | SEQ ID NO: 576 |
| Motif 2-3H2 SEQ ID NO: 533 | A**F**LRWGKFH**LA** a.a. 36-46 of SEQ ID NO: 533 | 3 | SEQ ID NO: 577 |
| Motif 2-3D4b SEQ ID NO: 534 | **T**YLRWGKFH**L**P a.a. 36-46 of SEQ ID NO: 534 | 2 | SEQ ID NO: 578 |
| Motif 2-3A5 SEQ ID NO: 535 | **TFM**RWGKFH**L**P a.a. 36-46 of SEQ ID NO: 535 | 4 | SEQ ID NO: 579 |
| Motif 2-3D5b SEQ ID NO: 536 | A**FM**RWGKFH**L**P a.a. 36-46 of SEQ ID NO: 536 | 3 | SEQ ID NO: 580 |
| Motif 2-3G2 SEQ ID NO: 537 | **TFV**RWGKFH**LA** a.a. 36-46 of SEQ ID NO: 537 | 5 | SEQ ID NO: 581 |
| Motif 2-3A3 SEQ ID NO: 538 | A**FI**RWGKFH**I**P a.a. 36-46 of SEQ ID NO: 538 | 3 | SEQ ID NO: 582 |
| Motif 2-3E8 SEQ ID NO: 539 | A**FV**RWGKFHVP a.a. 36-46 of SEQ ID NO: 539 | 2 | SEQ ID NO: 583 |
| Motif 2-3G8 SEQ ID NO: 540 | A**FV**RWGKFH**M**P a.a. 36-46 of SEQ ID NO: 540 | 3 | SEQ ID NO: 584 |
| Motif 2-3C3 SEQ ID NO: 541 | A**FI**RWGKFHV**A** a.a. 36-46 of SEQ ID NO: 541 | 3 | SEQ ID NO: 585 |
| Motif 2-3B7 SEQ ID NO: 542 | **TFI**RWGKFHV**A** a.a. 36-46 of SEQ ID NO: 542 | 4 | SEQ ID NO: 586 |
| Motif 2-3H7 SEQ ID NO: 543 | **TFI**RWGKFHVP a.a. 36-46 of SEQ ID NO: 543 | 3 | SEQ ID NO: 587 |
| Motif 2-3G3 SEQ ID NO: 544 | A**FV**RWGKFHV**A** a.a. 36-46 of SEQ ID NO: 544 | 3 | SEQ ID NO: 588 |
| Motif 2-3G5 SEQ ID NO: 545 | A**F**LRWGKFHV**A** a.a. 36-46 of SEQ ID NO: 545 | 2 | SEQ ID NO: 589 |

Example 26

Variants of AfIP-1A-31 with Multiple Amino Acid Substitutions in Motif 5

AfIP-1A-31 motif 5 variants with multiple selected amino acid substitutions in motif 5 were generated using the mutagenesis primer T7-F (TAATACGACTCACTATAGGG SEQ ID NO: 683) and the degenerate mutagenesis primer Motif 5-Comb-F (GTGGTGCTCGAGGGATTTTTT-GACAACAGTAATGWASABWTYGCCCGHCGHCSM-CGHTG GGCTACCGCCACCTTTTTTAATC SEQ ID NO: 686) as illustrated in FIG. 12.

The mutagenesis primer Motif 5-Comb-F was designed to be partially degenerate at residues 132, 133, 134, 135, 137, 138, and 139 of motif 5 corresponding to SEQ ID NO: 2 (AfIP-1A-31) resulting in selected amino acid substitutions at each residue. Table 31 shows the codon for each residue at position 132-140 relative to SEQ ID NO: 2 and the possible resulting amino acids. In Table 31 the native amino acid is indicated in bold and underlining.

The rescued mutant libraries were cloned into an E. coli expression vector, 480 individual isolates were expressed in E. coli, and cell lysates screened in the WCRW insecticidal assay as described previously. The respective isolates having a score of 10 or greater out of 18 in the WCRW screen were DNA sequenced to determine the amino acid sequence of the variant polypeptides. Table 32 shows for each AfIP-1A-31 variant the amino acid substitutions identified in motif 5 (a.a. 132-140), that were active in the WCRW insecticidal assay having a minimal score of 10 or greater out of 18. In Table 32 the amino acid substitutions in motif 5 compared to AfIP-1A-31 (SEQ ID NO: 2) are indicated in bold and underlining.

TABLE 31

| AfIP-1A-31 SEQ ID NO: 2 Residue # | codon | Degeneracy | Resulting amino acids* |
|---|---|---|---|
| 132 | **D**CG | D = A, G or T | **Ser**, Ala, and Thr |
| 133 | **K**SG | K = G or T<br>S = C or G | **Gly**, Ser, Trp and Ala |
| 134 | **D**CG | D = A, G or T | **Ala**, Ser, and Thr |
| 135 | **D**CG | D = A, G or T | **Thr**, Ser, and Ala |
| 136 | GGG | none | **Gly** |
| 137 | RAW | R = A or G<br>W = A or T | **Asn**, Asp, Glu, and Lys |
| 138 | VTS | V= A, G or C<br>S = C or G | **Ile**, Leu, Met, and Val |
| 139 | TWC | W = A or T | **Phe** and Tyr |
| 140 | ATC | none | **Ile** |

TABLE 32

| AfIP-1A-31 Variant | Motif 5 sequence | Number of substitutions | Polynucleotide sequence |
|---|---|---|---|
| AfIP-1A-31 SEQ ID NO: 2 | SGATGNIF a.a. 132-140 of SEQ ID NO: 2 | 0 | SEQ ID NO: 1 |
| MOT5-4C5 SEQ ID NO: 590 | **T**G**S**TG**E**IF a.a. 132-140 of SEQ ID NO: 590 | 3 | SEQ ID NO: 619 |
| MOT5-1F5 SEQ ID NO: 591 | TGATG**E**IF a.a. 132-140 of SEQ ID NO: 591 | 2 | SEQ ID NO: 620 |
| MOT5-3C1 SEQ ID NO: 592 | S**STS**G**EM**F a.a. 132-140 of SEQ ID NO: 592 | 5 | SEQ ID NO: 621 |
| MOT5-4H5 SEQ ID NO: 593 | SGA**A**G**EVY** a.a. 132-140 of SEQ ID NO: 593 | 4 | SEQ ID NO: 622 |
| MOT5-4A9 SEQ ID NO: 594 | S**ATA**G**EVY** a.a. 132-140 of SEQ ID NO: 594 | 6 | SEQ ID NO: 623 |
| MOT5-3A9 SEQ ID NO: 595 | **TS**A**A**GN**V**F a.a. 132-140 of SEQ ID NO: 595 | 4 | SEQ ID NO: 624 |
| MOT5-4D12 SEQ ID NO: 596 | **T**GA**S**G**DVY** a.a. 132-140 of SEQ ID NO: 596 | 5 | SEQ ID NO: 625 |
| MOT5-3F1 SEQ ID NO: 597 | SG**SA**GN**L**F a.a. 132-140 of SEQ ID NO: 597 | 3 | SEQ ID NO: 626 |
| MOT5-3H8 SEQ ID NO: 598 | SG**SA**G**KL**F a.a. 132-140 of SEQ ID NO: 598 | 4 | SEQ ID NO: 627 |
| MOT5-3G4 SEQ ID NO: 599 | **A**G**TS**GN**L**F a.a. 132-140 of SEQ ID NO: 599 | 4 | SEQ ID NO: 628 |
| MOT5-3F8 SEQ ID NO: 600 | **A**GA**S**GN**L**F a.a. 132-140 of SEQ ID NO: 600 | 3 | SEQ ID NO: 629 |
| MOT5-3E10 SEQ ID NO: 601 | **A**G**S**TGN**LY** a.a. 132-140 of SEQ ID NO: 601 | 4 | SEQ ID NO: 630 |
| MOT5-4A2 SEQ ID NO: 602 | **A**G**SA**GN**LY** a.a. 132-140 of SEQ ID NO: 602 | 5 | SEQ ID NO: 631 |
| MOT5-4F6 SEQ ID NO: 603 | **T**G**SS**G**EL**F a.a. 132-140 of SEQ ID NO: 603 | 5 | SEQ ID NO: 632 |
| MOT5-4F11 SEQ ID NO: 604 | **T**G**S**TG**KMY** a.a. 132-140 of SEQ ID NO: 604 | 5 | SEQ ID NO: 633 |
| MOT5-3F7 SEQ ID NO: 605 | **A**GATG**KV**F a.a. 132-140 of SEQ ID NO: 605 | 3 | SEQ ID NO: 634 |
| MOT5-4E11 SEQ ID NO: 606 | SG**S**TG**EV**F a.a. 132-140 of SEQ ID NO: 606 | 3 | SEQ ID NO: 635 |
| Mot5_2E1 SEQ ID NO: 607 | **T**GATGN**L**F a.a. 132-140 of SEQ ID NO: 607 | 2 | SEQ ID NO: 636 |

TABLE 32-continued

| AfIP-1A-31 Variant | Motif 5 sequence | Number of substitutions | Polynucleotide sequence |
|---|---|---|---|
| Mot5_2C5 SEQ ID NO: 608 | TSTTGKLY a.a. 132-140 of SEQ ID NO: 608 | 5 | SEQ ID NO: 637 |
| Mot5_2F11 SEQ ID NO: 609 | SGAAGDIF a.a. 132-140 of SEQ ID NO: 609 | 2 | SEQ ID NO: 638 |
| Mot5_4C10 SEQ ID NO: 610 | TGSTGKMY a.a. 132-140 of SEQ ID NO: 610 | 5 | SEQ ID NO: 639 |
| Mot5_5B4 SEQ ID NO: 611 | SGAAGDMY a.a. 132-140 of SEQ ID NO: 611 | 4 | SEQ ID NO: 640 |
| Mot5_5E1 SEQ ID NO: 612 | SGASGNVY a.a. 132-140 of SEQ ID NO: 612 | 3 | SEQ ID NO: 641 |
| Mot5_5E7 SEQ ID NO: 613 | AGSTGELF a.a. 132-140 of SEQ ID NO: 613 | 4 | SEQ ID NO: 642 |
| Mot5_5E9 SEQ ID NO: 614 | AGSSGKMF a.a. 132-140 of SEQ ID NO: 614 | 5 | SEQ ID NO: 643 |
| Mot5_5F7 SEQ ID NO: 615 | AGSTGDIY a.a. 132-140 of SEQ ID NO: 615 | 4 | SEQ ID NO: 644 |
| Mot5_5G6 SEQ ID NO: 616 | SGATGDIF a.a. 132-140 of SEQ ID NO: 616 | 1 | SEQ ID NO: 645 |
| Mot5_5H11 SEQ ID NO: 617 | TSSAGNMY a.a. 132-140 of SEQ ID NO: 617 | 6 | SEQ ID NO: 646 |
| Mot5_5A12 SEQ ID NO: 618 | TGTAGDIY a.a. 132-140 of SEQ ID NO: 618 | 5 | SEQ ID NO: 647 |

Example 27

Variants of AfIP-1A-31 with Multiple Amino Acid Substitutions in Motif 2 and Motif 5

AfIP-1A-31 variants with multiple selected amino acid substitutions in motif 2 and motif 5 were generated using the degenerate mutagenesis primer Motif 5-Comb-F (SEQ ID NO: 686) paired with the degenerate mutagenesis primer Motif 2-Comb-F (SEQ ID NO: 685) as illustrated in FIG. 12.

The rescued mutant libraries were cloned into an *E. coli* expression vector, 672 individual isolates were expressed in *E. coli*, and cell lysates screened in the WCRW insecticidal assay as described previously. The respective isolates having a score of 10 or greater out of 18 in the WCRW insecticidal screen were DNA sequenced to determine the amino acid sequence of the variant polypeptides. Table 33 shows for each AfIP-1A-31 variant the amino acid substitutions identified in motif 2 (a.a. 36-46) and motif 5 (a.a. 132-140) that were active in the WCRW insecticidal assay having a minimal score of 10 or greater out of 18. In Table 33 the amino acid substitutions in motif 2 and motif 5 compared to AfIP-1A-31 (SEQ ID NO: 2) are indicated in bold and underlining.

TABLE 33

| AfIP-1A-31 | motif sequence | | # subs | |
|---|---|---|---|---|
| Variant | Motif 2 | Motif 5 | Motif 2 | Motif 5 |
| AfIP-1A-31 SEQ ID NO: 2 | AYLRWGKFHVP a.a. 36-46 of SEQ ID NO: 2 | SGATGNIF a.a. 132-140 of SEQ ID NO: 2 | 0 | 0 |
| Motif 2 & 5-4E3 | AYVRWGKFHVP a.a. 36-46 of SEQ ID NO: 648 | TGSTGNLF a.a. 132-140 of SEQ ID NO: 648 | 1 | 3 |
| Motif 2 & 5-4A6 | AYVRWGKFHVP a.a. 36-46 of SEQ ID NO: 649 | SSTTGKVF a.a. 132-140 of SEQ ID NO: 649 | 1 | 4 |
| Motif 2 & 5-3H2 | AFMRWGKFHLA a.a. 36-46 of SEQ ID NO: 650 | SGSSGNIF a.a. 132-140 of SEQ ID NO: 650 | 4 | 2 |
| Motif 2 & 5-3H7 | AYLRWGKFHLA a.a. 36-46 of SEQ ID NO: 651 | SWTSGKVY a.a. 132-140 of SEQ ID NO: 651 | 2 | 6 |
| Motif 2 & 5-1H4 | AFVKWGKFHVA a.a. 36-46 of SEQ ID NO: 652 | TAATGNIY a.a. 132-140 of SEQ ID NO: 652 | 4 | 3 |

TABLE 33-continued

| AfIP-1A-31 Variant | motif sequence Motif 2 | Motif 5 | # subs Motif 2 | Motif 5 |
|---|---|---|---|---|
| Motif 2 & 5-2B1 | **TFV**RWGKFHVP a.a. 36-46 of SEQ ID NO: 653 | **AST**TGE**V**F a.a. 132-140 of SEQ ID NO: 653 | 3 | 4 |
| Motif 2 & 5-2F1 | AYL**K**WGKFHVP a.a. 36-46 of SEQ ID NO: 654 | S**W**ATGN**LY** a.a. 132-140 of SEQ ID NO: 654 | 1 | 3 |
| Motif 2 & 5-4H11 | **SF**LRWGKFHVP a.a. 36-46 of SEQ ID NO: 655 | **T**GA**S**GN**MY** a.a. 132-140 of SEQ ID NO: 655 | 2 | 4 |
| Motif 2 & 5-5A4 | A**FV**RWGKFH**L**P a.a. 36-46 of SEQ ID NO: 656 | **T**GATGN**V**F a.a. 132-140 of SEQ ID NO: 656 | 3 | 2 |
| Motif 2 & 5-5F11 | AY**V**RWGKFHV**A** a.a. 36-46 of SEQ ID NO: 657 | S**ASS**GNIF a.a. 132-140 of SEQ ID NO: 657 | 2 | 3 |
| Motif 2 & 5-6C3 | A**FVK**WGKFHV**A** a.a. 36-46 of SEQ ID NO: 658 | **T**G**SA**GN**MY** a.a. 132-140 of SEQ ID NO: 658 | 4 | 5 |
| Motif 2 & 5-7D5 | A**FI**RWGKFHVP a.a. 36-46 of SEQ ID NO: 659 | **A**GATG**ELY** a.a. 132-140 of SEQ ID NO: 659 | 2 | 4 |
| Motif 2 & 5-7F3 | **SYMK**WGKFHVP a.a. 36-46 of SEQ ID NO: 660 | SGA**S**G**E**I**Y** a.a. 132-140 of SEQ ID NO: 660 | 4 | 3 |
| Motif 2 & 5-7G8 | **SFV**RWGKFH**M**P a.a. 36-46 of SEQ ID NO: 661 | SGATGN**MY** a.a. 132-140 of SEQ ID NO: 661 | 4 | 2 |
| Motif 2 & 5-6D12 | AYLRWGKFHV**A** a.a. 36-46 of SEQ ID NO: 662 | **TAS**TGN**LY** a.a. 132-140 of SEQ ID NO: 662 | 1 | 5 |
| Motif 2 & 5-6C10 | AY**V**RWGKFHVP a.a. 36-46 of SEQ ID NO: 663 | **T**G**SA**G**K**I**Y** a.a. 132-140 of SEQ ID NO: 663 | 1 | 5 |
| Motif 2 & 5-6G2 | AY**VK**WGKFHV**A** a.a. 36-46 of SEQ ID NO: 664 | **TSS**TGN**VY** a.a. 132-140 of SEQ ID NO: 664 | 3 | 5 |

Example 28

AfIP-1B-32 Variants with Multiple Amino Acid Substitutions in Motif 5

Figure 13:
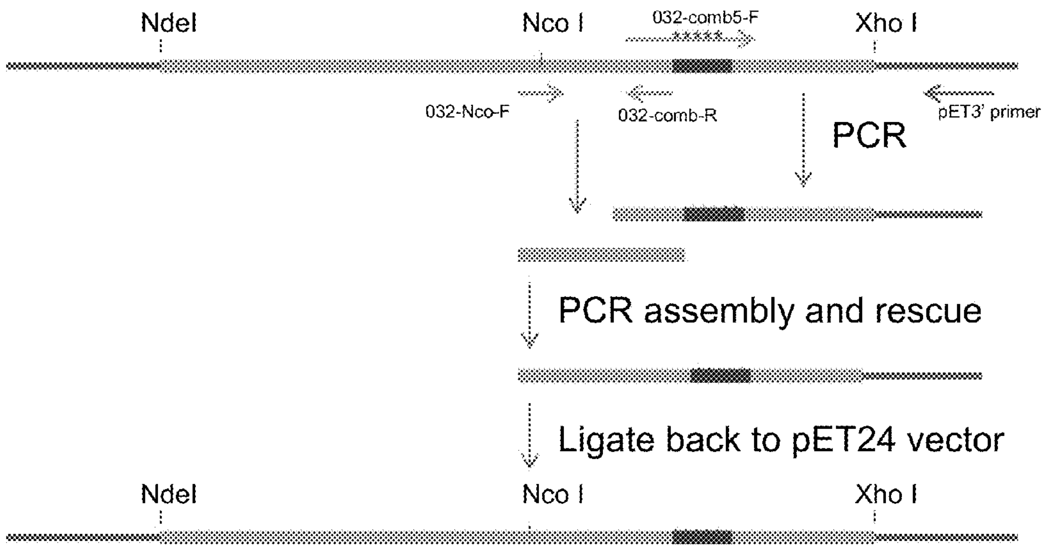
FIG. 13 shows the PCR mutagenesis strategy used to generate variants of AfIP-1B-32 with multiple amino acid substitutions in motif 5 (Example 28).

AfIP-1B-32 variants with multiple selected amino acid substitutions in motif 5 were generated by PCR using the degenerate mutagenesis primer 032-combo5-F ACCGC-CTGGAACGAAATTGGTBNSTTGCGCNKCGCG-SRGCTTVHSCTGGGCNDSCTCATT GGGGATCA-GTCAGTAAGCAG (SEQ ID NO: 749) and the primer pET3' (SEQ ID NO: 750). The product of the mutagenic PCR reaction was then mixed with the PCR product from the extension of primers 032-Nco-F (SEQ ID NO: 747) and 032-combo-R (SEQ ID NO:748), assembled and rescued by PCR, and cloned into the expression vector as shown in FIG. 13.

The mutagenesis primer 032-combo5-F (SEQ ID NO: 749) was designed to be partially degenerate at residues 509, 512, 514, 516 and 519 of motif 5 corresponding to SEQ ID NO: 4 (AfIP-1B-32) resulting in selected amino acid substitutions at each residue. Table 34 shows the codon for each residue at position 509, 512, 514, 516 and 519 relative to SEQ ID NO: 4 and the possible resulting amino acids. In Table 34 the native amino acid is indicated in bold and underlining.

The rescued mutant libraries were cloned into an *E. coli* expression vector, 1900 individual isolates were expressed in *E. coli*, and cell lysates screened in the WCRW insecticidal assay as described previously. The respective isolates having a score of 10 or greater out of 18 in the WCRW screen were DNA sequenced to determine the amino acid sequence of the variant polypeptides. Table 35 shows for each AfIP-1B-32 variant the amino acid substitutions identified in motif 5 (a.a. 509-519), that were active in the WCRW insecticidal assay having a minimal score of 10 or greater out of 18. In Table 35 the amino acid substitutions in motif 5 compared to AfIP-1B-32 (SEQ ID NO: 4) are indicated in bold and underlining.

TABLE 34

| AfIP-1B-32 SEQ ID NO: 4 Residue # | codon | Degeneracy | Resulting amino acids* |
|---|---|---|---|
| 509 | **BNS** | B = C, G or T<br>N = G, A, T or C<br>S = C or G | **Phe**, Leu, Trp, Arg, Cys, Pro, Val, Tyr, Ala, Ser |
| 510 | TTG | none | **Leu** |
| 511 | CGC | none | **Arg** |
| 512 | **NKC** | N = G, A, T or C<br>K = G or T | **Asn**, Leu, Phe, Val, Gly, Arg, Ser, Cys, Arg, Ile, Gly |
| 513 | GCG | none | **Ala** |
| 514 | **SRG** | S = C or G<br>R = A or G | **Glu**, Gln, Gly |
| 515 | CTT | none | **Leu** |
| 516 | VHS | V = A, C or G<br>H = A,C or T<br>S = C or G | **Gly**, Met, Glu, Ala, Asn, Val, Leu, Thr, Gln |

TABLE 34-continued

| AfIP-1B-32 SEQ ID NO: 4 Residue # | codon Degeneracy | Resulting amino acids* |
|---|---|---|
| 517 | CTG **none** | **Leu** |
| 518 | GGC none | **Gly** |
| 519 | **NDS** N = G, A, T or C | **Leu** Gln, Met, Val, |
| | D = A, G or T | Phe, Cys, Arg |
| | S = C or G | |

TABLE 35

| AfIP-1B-32 Variant | Motif 5 sequence | Number of substitutions | Polynucleotide sequence |
|---|---|---|---|
| AfIP-1B-32 SEQ ID NO: 4 | FLRNAELGLGL a.a. 509-519 of SEQ ID NO: 4 | | SEQ ID NO: 3 |
| 32-comb5-A-1 SEQ ID NO: 687 | **L**LR**L**AEL**M**LG**Q** a.a. 509-519 of SEQ ID NO: 687 | 4 | SEQ ID NO: 709 |
| 32-comb5-A-2 SEQ ID NO: 688 | **W**LR**F**AEL**E**LG**M** a.a. 509-519 of SEQ ID NO: 688 | 4 | SEQ ID NO: 710 |
| 32-comb5-A-3 SEQ ID NO: 689 | **R**LR**L**AEL**A**LGL a.a. 509-519 of SEQ ID NO: 689 | 3 | SEQ ID NO: 711 |
| 32-comb5-A-4 SEQ ID NO: 690 | **W**LR**V**AEL**A**LGL a.a. 509-519 of SEQ ID NO: 690 | 3 | SEQ ID NO: 712 |
| 32-comb5-A-5 SEQ ID NO: 691 | **C**LR**F**AEL**A**LGL a.a. 509-519 of SEQ ID NO: 691 | 3 | SEQ ID NO: 713 |
| 32-comb5-A-10 SEQ ID NO: 692 | **C**LR**G**AEL**N**LGL a.a. 509-519 of SEQ ID NO: 692 | 3 | SEQ ID NO: 714 |
| 32-comb5-A-11 SEQ ID NO: 693 | **L**LR**G**AEL**A**LG**V** a.a. 509-519 of SEQ ID NO: 693 | 4 | SEQ ID NO: 715 |
| 32-comb5-A-14 SEQ ID NO: 694 | **P**LR**R**A**Q**L**V**LG**V** a.a. 509-519 of SEQ ID NO: 694 | 5 | SEQ ID NO: 716 |
| 32-comb5-A-18 SEQ ID NO: 695 | FLR**V**AEL**I**LGL a.a. 509-519 of SEQ ID NO: 695 | 3 | SEQ ID NO: 717 |
| 32-comb5-A-24 SEQ ID NO: 696 | **L**LR**S**AEL**V**LG**F** a.a. 509-519 of SEQ ID NO: 696 | 4 | SEQ ID NO: 718 |
| 32-comb5-A-26 SEQ ID NO: 697 | **V**LR**L**A**G**L**E**LG**C** a.a. 509-519 of SEQ ID NO: 697 | 5 | SEQ ID NO: 719 |
| 32-comb5-A-27 SEQ ID NO: 698 | **Y**LR**V**AEL**A**LG**V** a.a. 509-519 of SEQ ID NO: 698 | 4 | SEQ ID NO: 720 |
| 32-comb5-A-28 SEQ ID NO: 699 | **V**LR**C**AEL**A**LG**I** a.a. 509-519 of SEQ ID NO: 699 | 4 | SEQ ID NO: 721 |
| 32-comb5-A-41 SEQ ID NO: 700 | **A**LR**R**AEL**T**LGL a.a. 509-519 of SEQ ID NO: 700 | 4 | SEQ ID NO: 722 |
| 32-comb5-A-45 SEQ ID NO: 701 | **V**LR**I**AEL**Q**LGL a.a. 509-519 of SEQ ID NO: 701 | 3 | SEQ ID NO: 723 |

TABLE 35-continued

| AfIP-1B-32 Variant | Motif 5 sequence | Number of substitutions | Polynucleotide sequence |
|---|---|---|---|
| 32-comb5-A-46 SEQ ID NO: 702 | **A**LR**G**AEL**T**LGL a.a. 509-519 of SEQ ID NO: 702 | 3 | SEQ ID NO: 724 |
| 32-comb5-A-50 SEQ ID NO: 703 | **S**LR**F**AEL**A**LGL a.a. 509-519 of SEQ ID NO: 703 | 3 | SEQ ID NO: 725 |
| 32-comb5-A-60 SEQ ID NO: 704 | **P**LR**L**A**G**L**A**LG**R** a.a. 509-519 of SEQ ID NO: 704 | 5 | SEQ ID NO: 726 |
| 32-comb5-A-65 SEQ ID NO: 705 | FLR**I**AEL**A**LGL a.a. 509-519 of SEQ ID NO: 705 | 2 | SEQ ID NO: 727 |
| 32-comb5-A-128 SEQ ID NO: 706 | **P**LRNAELGLGL a.a. 509-519 of SEQ ID NO: 706 | 1 | SEQ ID NO: 728 |
| 32-comb5-A-130 SEQ ID NO: 707 | **P**LRNAELGLG**C** a.a. 509-519 of SEQ ID NO: 707 | 2 | SEQ ID NO: 729 |
| 32-comb5-A-135 SEQ ID NO: 708 | **W**LR**S**AEL**T**LGL a.a. 509-519 of SEQ ID NO: 708 | 3 | SEQ ID NO: 730 |

Example 29

*Agrobacterium*-Mediated Transformation of Maize

For *Agrobacterium*-mediated maize transformation with the AfIP-1A-31 and AfIP-1B-32, the method of Zhao was employed (U.S. Pat. No. 5,981,840 and International Patent Publication Number WO 1998/32326, the contents of which are hereby incorporated by reference). Briefly, immature embryos were isolated from maize and the embryos contacted with an *Agrobacterium* Suspension, where the bacteria were capable of transferring AfIP-1A-31 and AfIP-1B-32 to at least one cell of at least one of the immature embryos (step 1: the infection step). In this step the immature embryos were immersed in an *Agrobacterium* suspension for the initiation of inoculation. The embryos were co-cultured for a time with the *Agrobacterium* (step 2: the co-cultivation step). The immature embryos were cultured on solid medium following the infection step. Following this co-cultivation period an optional resting step was contemplated. In this resting step, the embryos were incubated in the presence of at least one antibiotic known to inhibit *Agrobacterium* growth without a plant transformant selective agent (step 3: resting step). The immature embryos were cultured on solid medium with antibiotic, but without a selecting agent, for *Agrobacterium* elimination and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium were cultured on solid medium to regenerate the plants.

For detection of the AfIP-1A-31 and AfIP-1B-32 proteins in leaf tissue 4 lyophilized leaf punches/sample were pulverized and resuspended in 100 μL PBS containing 0.1% Tween 20 (PBST), 1% beta-mercaoptoethanol containing 1 tablet/7 mL complete Mini proteinase inhibitor (Roche 1183615301). The suspension was sonicated for 2 min and then centrifuged at 4° C., 20,000 g for 15 min. To a supernatant aliquot 1/3 volume of 3×NuPAGE® LDS Sample Buffer (Invitrogen™ (CA, USA), 1% B-ME containing 1 tablet/7 mL complete Mini proteinase inhibitor was added. The reaction was heated at 80° C. for 10 min and then centrifuged. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified rabbit anti-AfIP-1A-31 and affinity-purified rabbit anti-AfIP-1B-32 at 1:20,000 in PBST overnight. The membrane was rinsed three times with PBST and then incubated in PBST for 15 min and then two times 5 min before incubating for 2 hours in PBST with goat anti-rabbit-HRP at 1:20,000 for 3 hours. The detected proteins were visualized using ECL Western Blotting Reagents (GE Healthcare cat #RPN2106) and Kodak® Biomax® MR film. For detection of the AfIP-1A-31, AfIP-1B-32 proteins in roots the roots were lyophilized and 2 mg powder per sample was resuspended in LDS, 1% B-ME containing 1 tablet/7 mL Complete Mini proteinase inhibitor was added. The reaction was heated at 80° C. for 10 min and then centrifuged at 4° C., 20,000 g for 15 min. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified polyclonal rabbit anti-AfIP-1A-31 and affinity-purified polyclonal rabbit anti-AfIP-1B-32 at 1:20,000 in PBST overnight. The membrane was rinsed three times with PBST and then incubated in PBST for 15 min and then two times 5 min before incubating for 2 hours in PBST with goat anti-rabbit-HRP at 1:20,000 for 3 hrs. The antibody bound insecticidal proteins were detected using ECL™ Western Blotting Reagents (GE Healthcare cat #RPN2106) and Kodak® Biomax® MR film.

Example 30

Particle Bombardment Transformation and Regeneration of Transgenic Plants

Immature maize embryos from greenhouse donor plants are bombarded with a plasmid containing a nucleotide sequence encoding the insecticidal protein. The ears are husked and surface sterilized in 30% Clorox® bleach plus 0.5% Micro detergent for 20 minutes and rinsed two times with sterile water. The immature embryos are excised and placed embryo axis side down (scutellum side up), 25 embryos per plate, on 560Y medium for 4 hours and then aligned within the 2.5 cm target zone in preparation for bombardment. A plasmid vector DNA comprising the nucleotide sequence encoding the insecticidal protein operably linked to a promoter is precipitated onto 1.1 μm (average diameter) tungsten pellets using a $CaCl_2$ precipitation procedure as follows: 100 μl prepared tungsten particles in water; 10 μl (1 μg) DNA in Tris EDTA buffer (1 μg total DNA); 100 μl 2.5 M $CaCl_2$ and 10 μl 0.1 M spermidine.

Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment. The sample plates are bombarded at level #4 in a particle gun. All samples receive a single shot at 650 PSI, with a total of ten aliquots taken from each tube of prepared particles/DNA Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for expression of the modified AfIP-1A-31 and IP032 by assays known in the art, such as, for example, immunoassays and western blotting.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

Bombardment medium (560Y) comprises 4.0 g/l N6 basal salts (SIGMA C-1416), 1.0 ml/l Eriksson's Vitamin Mix (1000.times.SIGMA-1511), 0.5 mg/l thiamine HCl, 120.0 g/l sucrose, 1.0 mg/l 2,4-D and 2.88 g/l L-proline (brought to volume with D-I $H_2O$ following adjustment to pH 5.8 with KOH); 2.0 g/l Gelrite (added after bringing to volume with D-I $H_2O$) and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000.times.SIGMA-1511), 0.5 mg/l thiamine HCl, 30.0 g/l sucrose and 2.0 mg/l 2,4-D (brought to volume with D-I $H_2O$ following adjustment to pH 5.8 with KOH); 3.0 g/l Gelrite (added after bringing to volume with D-I $H_2O$) and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog, (1962) *Physiol. Plant.* 15:473), 100 mg/l myo-inositol, 0.5 mg/l zeatin, 60 g/l sucrose and 1.0 ml/l of 0.1 mM abscisic acid (brought to volume with polished D-I $H_2O$ after adjusting to pH 5.6); 3.0 g/l Gelrite (added after bringing to volume with D-I $H_2O$) and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL and 0.40 g/l glycine brought to volume with polished D-I $H_2O$), 0.1 g/l myo-inositol and 40.0 g/l sucrose (brought to volume with polished D-I $H_2O$ after adjusting pH to 5.6) and 6 g/l bacto-agar (added after bringing to volume with polished D-I $H_2O$), sterilized and cooled to 60° C.

The above description of various illustrated embodiments of the invention is not intended to be exhaustive or to limit the invention to the precise form disclosed. While specific embodiments of, and examples for, the invention are described herein for illustrative purposes, various equivalent modifications are possible within the scope of the invention, as those skilled in the relevant art will recognize. The teachings provided herein of the invention can be applied to other purposes, other than the examples described above. The invention may be practiced in ways other than those particularly described in the foregoing description and examples. Numerous modifications and variations of the invention are possible in light of the above teachings and, therefore, are within the scope of the appended claims.

These and other changes may be made to the invention in light of the above detailed description. In general, in the following claims, the terms used should not be construed to limit the invention to the specific embodiments disclosed in the specification and the claims.

Certain teachings related to AfIP-1A and AfIP-1B polynucleotides and polypeptides were disclosed in U.S. Provisional Application No. 61/675,950, filed Jul. 26, 2012 and U.S. Provisional Application No. 61/739,468, filed Dec. 19, 2012, the disclosure of which is herein incorporated by reference in its entirety.

The entire disclosure of each document cited (including patents, patent applications, journal articles, abstracts, manuals, books, or other disclosures) in the Background of the Invention, Detailed Description, and Examples is herein incorporated by reference in their entireties.

The following examples are put forth so as to provide those of ordinary skill in the art with a complete disclosure and description of how to make and use the subject invention, and are not intended to limit the scope of what is regarded as the invention. Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (776 sequences)

SEQ ID NO: 1 - DNA, 438 bp, Alcaligenes faecalis
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 2 - protein, 146 aa, Alcaligenes faecalis
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 3 - DNA, 2109 bp, Alcaligenes faecalis
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 4 - protein, 703 aa, Alcaligenes faecalis
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 5 - DNA, 423 bp, Artificial Sequence
  AfIP-1A-31 variant
attgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 6 - protein, 141 aa, Artificial Sequence
  AfIP-1A-31 variant
IATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 7 - DNA, 20 bp, Artificial Sequence
  16S RNA primer
agagtttgatcctggctcag

SEQ ID NO: 8 - DNA, 21 bp, Artificial Sequence
  16S RNA primer
acggctaccttgttacgactt

SEQ ID NO: 9 - DNA, 23 bp, Artificial Sequence
  cloning primer
gctgaggacttacatatgactgc

SEQ ID NO: 10 - DNA, 29 bp, Artificial Sequence
  cloning primer
cttctatgtccaggatcctctcccttagg

SEQ ID NO: 11 - DNA, 31 bp, Artificial Sequence
  cloning primer
ggagaaacatatggacatagaagctaaatcc

SEQ ID NO: 12 - DNA, 23 bp, Artificial Sequence
  cloning primer
ggaggatccctgagtttcaggcc

SEQ ID NO: 13 - DNA, 405 bp, Spirosoma linguale
atggcatattcagaatgggtcgaaatcaggatttactccgagaatatggagatcaaaatcaaaaacattaagttaaactggggtaaattttacgaagggcccaaccaagacatcgaaattacagcgcctgtgctgtcagatgcagtgatcaagtcaggtgagaaatacacggtctggtcgtgtgggcgagatggtgcttcaagcggtacggaaggaagtttcgaattgtatgacggggatacgcaagtagcccgctttgggtggatttgcccctggtcaggcgctaattcctgttcattaatacctggcgagcaagaaaataagctctataaaaccgcccggcagtggagcggcttaaccagtggccccctcggtacgataacactcagttgtgtaaagttatta

SEQ ID NO: 14 - protein, 135 aa, Spirosoma linguale
MAYSEWVEIRIYSENMEIKIKNIKLNWGKFYEGPNQDIEITAPVLSDAVIKSGEKYTVWSCGRDGASSGTEGSFELYDGDTQVARFGWICPWSGANSCSLIPGEQENKLYKTARQWSGLTSGPLGTITLSCVKLL

SEQ ID NO: 15 - DNA, 2235 bp, Spirosoma linguale
atgagtaaaacagcaagcaccgagctccggtacaatccgttttatgcggtacgggtcggttcaaccattgacggtaacacaagccagttttttccgacggtgattgcagatacggatgccagtgacaaaccggttgccattacgacgcttagtgcagagaaagatatgcgtacctcgatgacgggcgagagttcatacgtctataacgaccagatgaatcagggttcattgggcgtggccggttcatacggggtgtcgggagtcagcaaagtatcggcggcagtgagtgtatatgccggcaaatcgtcggcgagcagtagctcgtccattaatctgaactataacgtacagttgctggccggggtcgaatacattgattttgacagattaagccccgaaactctgctcaatgctcttaaaaatggaccgagataccgcgcactggctgcgctaacaaaatttttggacgtaaagaaggcgatccagaaccgtaatctggtggaagctctcaaagaccccgcccagaaagaagaaatcgagcgggtactggcgggttggcataatgctagggagaattttttcaaacaagacggcgacgggctggtcgtgggcgtaatgtggggcgggttaggtacggtttcgctgcaaatcgataacaccagcggccagagcaactggaaatacggcggcaggggcaatttcagctacgccggcataaatggttcggtttctgtggaagcggcctacgatggcagccagcaaagaaaaaatacagatgtgaaagtcagttgctcatcggttgcaatggggggctgcatcagccagcaaatcgcggactgggagaagaaattcacaaaccttggtttcgataaactggctgatgccaaactactcgacagcgcaccaggtatcgataccctcaatacaacgcctacggcaccagccttcgtcgagccgacgaaggataaagggattgccgcaagaattgaagcgataagagacctgaatggactcgaagcctttgccattgcttctgcctacgacaaagccagcaaagacccgaaaaacaaggatctgacgctcgctcaatttatcgaccaaacaaaaaaaccggcagataccagggcggtagacgaattgacttccaacgcagccaacaacgacatagacgtattgacgacctcgggcctggaggctggcctggaagaagagagcctgttaccgcctgatgatatatccgaaccagccttgacccgcactgctgacgacttcacggtactgggagtctggattgccaactgggccgatttgtttccgtggctggcaaccggctatcttaatgaggtaagcacggttgaggccgcccagcaaatactcgctaaacaatgtatgattcaggacttgttgaccctgaccagactttaccgcacactggcttcgaccggactgaaatacgaacagttaggcattacggctccgttcgaccaaatagctaactcatttagccaagagtatagctggctgaaagataatcttgataaaaacaatgcagttcggcaaagctatggccaacttggaatacaggcacgggctatttatggtttttggaatacatacggatttctgcgcggagccgaattgggccttgggctgatgcttgacgataaatcgctgacgaccactatttcaaagcaggaggtagcggatgatttcatttgtcaaacctacacactcgaatcctgtacgtttgtgacggatacaaaaaccaactatagtgggtttgcttcctttctgaagttgttgccttttatcacgcccgacggcaaggtgtatgtctttggcccggccaatatgctggtgagcgaagttactgatgagggcatagtcttgtcgaaaaatcctgccaaagcgatggcgtttaccgccgatacaaccaacaagctattgaccaacggcaacctgaaactttatccaataccattcagcggagcggagggcgttagagaatggatgggccaaagcgtcagcacgaacctggcgtcgagcataacgctgaaaaaaaggcttaataacgtaaaagaccaattaacagagctcagtacctatagtttcagcagcgataactggaataacgacgcaaacgcacaggccccctacagtatccggctaataaaaacgcagtacgtcggactgatggaagccgcccaaagcgtatttaacggaaagccccacccc

SEQ ID NO: 16 - protein, 745 aa, Spirosoma linguale
MSKTASTELRYNPFYAVRVGSTIDGNTSQFFPTVIADTDASDKPVAITTLSAEKDMRTSMTGESSYVYNDQMNQGSLGVAGSYGVSGVSKVSAAVSVYAGKSSASSSSSINLNYNVQLLAGVEYIDFDRLSPETLLNALKNGPRYRALAALTKFLDVKKAIQNRNLVEALKDPAQKEEIERVLAGWHNARENFFKQDGDGLVVGVMWGGLGTVSLQIDNTSGQSNWKYGGRGNFSYAGINGSVSVEAAYDGSQQRKNTDVKVSCSSVAMGGCISQQIADWEKKFTNLGFDKLADAKLLDSAPGIDTLNTTPTAPAFVEPTKDKGIAARIEAIRDLNGLEAFAIASAYDKASKDPKNKDLTLAQFIDQTKKPADTRAVDELTSNAANNDIDVLTTSGLEAGLEEESLLPPDDISEPALTRTADDFTVLGVWIANWADLFPWLATGYLNEVSTVEAAQQILAKQCMIQDLLTLTRLYRTLASTGLKYEQLGITAPFDQIANSFSQEYSWLKDNLDKNNAVRQSYGQLGIQARAIYGFWNTYGFLRGAELGLGLMLDDKSLTTTISKQEVADDFICQTYTLESCTFVTDTKTNYSGFASFLKLLPFITPDGKVYVFGPANMLVSEVTDEGIVLSKNPAKAMAFTADTTNKLLTNGNLKLYPIPFSGAEGVREWMGQSVSTNLASSITLKKRLNNVKDQLTELSTYSFSSDNWNNDANAQAPYSIRLIKTQYVGLMEAAQSVFNGKPHP

SEQ ID NO: 17 - DNA, 420 bp, UNKNOWN
  Fungus-growing Termite Worker hypothetical gene
atggatcttaatgtagaagttcaggctcaatcacaatgggttgagatcgaaattttctctgaaaacatggatatcgaaataaaaaaagcggagttgctttgggggaaattccataagcctggaaataaaagcaatgaaatttcaagtgacaccgttaataaaaccaaaataagttcaggtacaaaatccaagattgcatcttgtggtagagcggatacatcatctggtacggaagggaaatttgaaatttatcatgatgataaatggctagccacttataagtgggattgtccttgggcgggttctaattctcattctttaagtgttactcaggacaatgactataaaattgataaggaaggaggaaatataagtgatggagcattaggtaatattagaattacctgtattaaagttggt

SEQ ID NO: 18 - protein, 140 aa, UNKNOWN
  Fungus-growing Termite Worker hypothetical protein
MDLNVEVQAQSQWVEIEIFSENMDIEIKKAELLWGKFHKPGNKSNEISSDTVNKTKISSGTKSKIASCGRADTSSGTEGKFEIYHDDKWLATYKWDCPWAGSNSHSLSVTQDNDYKIDKEGGNISDGALGNIRITCIKVG

SEQ ID NO: 19 - DNA, 2151 bp, UNKNOWN
  Fungus-growing Termite Worker hypothetical gene
atgaaaacacagattgaaatagttaacccttttgcaggggtgaaaataggttcatatgtttcaggtaatcaatttagcccatcggttattacgggtgatattacccgaatggaagaagttctagaggtgcaaaaatatatttcagggcgaagcaactacgtctactctgataaacttaatgaagcctcgctgggggtttctggagcttatggcgtaaccggggtatcaaaactaacttcttccgtatctgctcatgccggtaacgctaccgcctctgcagataaatctattaaacttagttataatatatcgatgatttcaggcatcgaatatattgattttgacagtctgaccgctgaagacattcttaattctctaaagcctgggccgaaaagtctggttgttgatgttctggataaatttaatacattacgcgattatcagcaggagaataacctgtcactattcgataataatatgtcgtttattcaggatgcccgtcaggatgagcttgtacaggactggcttaaagcactgaattatttttatcagacgtatgcggatggtatggttgtaggtgttatttgggggggcattggtggtgtgagtatggatatcggcaggtctagttatgagaaaaactggacctacggtgggcaagctgattttacctactcaggaacgggtgctgcggtgtctgtagctgccacttataacggtaagcagtctgataaggggacatcagttgatgtttcttgctcatcattcagcagtggtacttgcgtagtaaatcaggtgaatgaatggtttaaagtggtagaaaacaaagcctacagtgagatcacggatcttaagcttttagacagtgcccctgctcaagggggggttaagccgcctccgccgctaccgccatttgtcgttccaaaaaaagatcctgccattgaacataaactcgccaaaattggtcgattaggtaacactgaagagctatccatcatgtccggctacgataaagccaaaaaagatgatagctcaatgaccccagaaaaattcaaggagaaaactcgtcagcgtaactcactggataaactgaccgaactagagattaaattaaagggtaaccagctggatgtactgcttgacatcaacaaagtcattagcgtggagtcaccatctttcgagccgattgctatggcagataatcattctggttttgtcccgcttggtgtctggattgtcaactgggctgatattttcccatggttatcaacaggatatttgaacgacatttcagataccgctgcagcagaattggcgttgaaaaaacgctgcatgatgcaggatttttgtaccctcagtagtatttataatactttccactcaagtggtatcaaaatggaagggaagctggatgcgcctgaccaaatagcaaatgcattcagtaacgcgcttactattttgaaggacaatcaggatcaggacaacgttattcaacaggcatatgacagattaggatctgacgcacaaggaatctataagatatggaatcataacggtttcctgcgtaatgcagaattagggtttgggctgatgtttgatacaaatcgttctatcagcagcaccgttgaccgtgtcaagggcgttccccatccagaagtggtttacaaaagtgaatactgctcatttgacaaggtaaattaccatgcatttgctaaatcaatgaaggtattacctatcattgaccttggaggcaatgtctatgcgtttggtccatctgctatgttactgaaaaatactataaataatgaggttacgttcacgaaaagtgtcttaacggcgatgcgttttgagattgataaggataacaaaatactgaaaaactcaacaactaaattatatccgataccttgttccgcagcaaaaggtattaacgactggaaagggccgggagtaggtatcaacttgtcttccagcaaatcgctcagcgatcagcttgaagctctcaggaatgagctattgaaactcaatagctgtagcgtgagtagtgataagtggaaccccgtctggcaatacaccgatccgtatcatctcaaagagatgggaacatcatacattggattggttaacaaaacagcgaaaaccatttttcct

SEQ ID NO: 20 - protein, 717 aa, UNKNOWN
  Fungus-growing Termite Worker hypothetical protein
MKTQIEIVNPFAGVKIGSYVSGNQFSPSVITGDITRMEEVLEVQKYISGRSNYVYSDKLNEASLGVSGAYGVTGVSKLTSSVSAHAGNATASADKSIKLSYNISMISGIEYIDFDSLTAEDILNSLKPGPKSLVVDVLDKFNTLRDYQQENNLSLFDNNMSFIQDARQDELVQDWLKALNYFYQTYADGMVVGVIWGGIGGVSMDIGRSSYEKNWTYGGQADFTYSGTGAAVSVAATYNGKQSDKGTSVDVSCSSFSSGTCVVNQVNEWFKVVENKAYSEITDLKLLDSAPAQGGVKPPPPLPPFVVPKKDPAIEHKLAKIGRLGNTEELSIMSGYDKAKKDDSSMTPEKFKEKTRQRNSLDKLTELEIKLKGNQLDVLLDINKVISVESPSFEPIAMADNHSGFVPLGVWIVNWADIFPWLSTGYLNDISDTAAAELALKKRCMMQDFCTLSSIYNTFHSSGIKMEGKLDAPDQIANAFSNALTILKDNQDQDNVIQQAYDRLGSDAQGIYKIWNHNGFLRNAELGFGLMFDTNRSISSTVDRVKGVPHPEVVYKSEYCSFDKVNYHAFAKSMKVLPIIDLGGNVYAFGPSAMLLKNTINNEVTFTKSVLTAMRFEIDKDNKILKNSTTKLYPIPCSAAKGINDWKGPGVGINLSSSKSLSDQLEALRNELLKLNSCSVSSDKWNPVWQYTDPYHLKEMGTSYIGLVNKTAKTIFP

SEQ ID NO: 21 - DNA, 444 bp, Artificial Sequence
  E. coli optimized
atgaccgctaaagatatcgctaccgaggagagcaagattcgtgcttacgcgcagtggattgagattaccatcttcgttgtgaactccaacttcaaagtggaaggtgcttatctgcgttggggtaagttccatgtgccaggcgacaaagacaaggagatcagccctagccagatcaatggcactatcatcaaggacgaagactcctacaccattgcctcttgtggtcgcgagaatgctagctctggtactgaaggtggcttcagcctgtatgatggtgacaaactggtgtttgagtactactgggattgcccatggtctggttccaacagcgatgagctgaccgttaaggacaaggagaactacaccgtgatcaagaagggtggtggttctccatctggcgcaactggcaatatcttcattactgttgtcaagaagtccctcgag

SEQ ID NO: 22 - DNA, 2118 bp, Artificial Sequence
  E. coli optimized
atggatattgaagcgaaatctatcaatccgctgatgggtatcactgtgggtagcactgttctgggcaacgacttcaaaccgagcgttctgatcaacccgatcacccgtatgattactcagaaagagatcgagatgggcatgtctggtaaatcccagtacgtttacaccgattctctgaacgaaggcaccattggcttctccggtgcttatggtccatcgggcatcgcaaaattcacctctgcggtagcggttagcgtaagcaatgcaactgcaagcgagtacaaatctatcaaggtctcgtacaacatcagcatgatcagcggtatcgagtacattgatttcgacaacctgacggttgaagatgttctgaactccctgagtgcaggtccgaaaaacctgtccctgaaagtactggagaagttcatcgctgcacgcgattgctctggctcttccattgaaaaggacgaactgatgaaagagtgggttaaaagcctgcagaactttatcagcagctatggcgatggtttggttgtaggtgctatctggggaggcatgggctccgttagcactgagatgacttccaaaaagaccgaagactcgtggaagtatggcgaaactgcggagttttcctacagtggtattggctctagtgtgtccattgcacagacttacaacggttcccagaaggatcagtcttccgaagttgaagtatcctgcaaagctctggcaagtggaggttgtgttgaatcccaggtcaactcttggttcgatgtggttgccaacaagtcgtttgcagaaatctccggcatttctctgctggacaaagctccgatgcagagctctgtgagtccacctccgaagatcccagacttcctgaaaccggagaagaacgcagagatcactgagaaactggacaccatcaaaaagctgggtgactccgaggaattcgcactggctagtggttatgaggaagcgaagaagaccaacccaaacctgaccttcgaagagttcaaatctaccgtccgtgataagaacaacatcgacggtcttaacgaactggcgtctaaagtccaggagaactcccttgatgtgcttgcagaaggctcaatctctcgtcgcaacaagaatctttccctgcaaggtgttcgtaccatcagtttggacagttcatctgattacgcagttctgggtgcatggatcgctaactggagcgacatctttccgtggatgagtatggggtacatgaacgaaatcagtgatgccgaagtggcggaatacattctgaagatccgttgcatgatgcaggatctgtctaccctgaacaccatctacaacaccttcaacgcttgcaacatcaagctggacttctgccacttgaactctgcttcacaggttgcagactcattcaagatcgctcagggtgtactgtctgacaacgtagaatcggacgatgcggttgaaatcgcgttcaactctctgtcggatgaagcgaagaagatctacactgcatggaatgagatcggtttcctgcgcaatgctgaactgggtcttggactgttaatcggtgatcagtctgtctctagcgagatcattgatgtgaaacctattccgtatccggaagtgacttacaaggctgcttattgttcctacggcaacaacaacccgactgcattttccagcttcatcaaaatgctgccgttcatcgacacaaacggtgatatctacgcgtttggtccaagtctgatgctgcttcgtaaagcactgcctgagaagatgatcttcactaaaggtggtgagatggctatgaaactgaccgctgacaaggacactggtattctgacgaacgacagtgtcaaactcattccgatcccatacagtgctgctaaaggcatccaatggcgtggtcaaggtcaaggtcgcagtcttgcgtcttctcagtcccttcaggatcagttcgcagctctggagaaagagttgggcaacctgaacatctgcaccctgagctctgactcttggtccaaagattggacctacacagtgccttacactctgcgcaaaatctctaccacctacatcggcactgtggagaagatcaactctattttcggctaaggatcc

SEQ ID NO: 23 - DNA, 462 bp, Artificial Sequence
  E. coli optimized
atgaccgctaaagatatcgctaccgaggagagcaagattcgtgcttacgcgcagtggattgagattaccatcttcgttgtgaactccaacttcaaagtggaaggtgcttatctgcgttggggtaagttccatgtgccaggcgacaaagacaaggagatcagccctagccagatcaatggcactatcatcaaggacgaagactcctacaccattgcctcttgtggtcgcgagaatgctagctctggtactgaaggtggcttcagcctgtatgatggtgacaaactggtgtttgagtactactgggattgcccatggtctggttccaacagcgatgagctgaccgttaaggacaaggagaactacaccgtgatcaagaagggtggtggttctccatctggcgcaactggcaatatcttcattactgttgtcaagaagtccctcgagcaccaccaccaccaccac

SEQ ID NO: 24 - protein, 154 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEHHHHHH

SEQ ID NO: 25 - DNA, 1652 bp, Artificial Sequence
  E. coli optimized
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatgg

SEQ ID NO: 26 - protein, 711 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFGLEHHHHHH

SEQ ID NO: 27 - DNA, 438 bp, Alcaligenes faecalis
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgtgagaacgcctcgtcaggaactgaaggaggtttctccctgtacgacggtgataaattagtttttgaatattactgggattgcccctggagtggttccaacagcgatgagctcaccgttaaggataaagaaaactacacagtgataaaaaaaggtggcggtagcccaagtggcgcgacaggcaatatcttcattactgttgtcaaaaaatcc

SEQ ID NO: 28 - protein, 146 aa, Alcaligenes faecalis; identical to SEQ ID NO: 2

SEQ ID NO: 29 - DNA, 2078 bp, Alcaligenes faecalis
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtccataaaagtctcctacaatatttccatgatctcgggaatagaatatatcgactttgacaatctgacggtagaggacgtattaaactccttaagtgcaggacctaaaaatctttcgttaaaggttttagagaaattcattgctgtccgtgactgctttggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagaaataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcaatgatgccgaggttgcggagtacatcctgaaaatccgttgcatgatgcaagatctgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatctctgatgctattgcgaaaagctttgcctgaaaaaatgattttcaccaaaggcggagaaatggcaatgaagctaacggctgataaagacacaggtattctgactaacgacagtgtcaagttgatacctattccatactctgccgcaaagggaattcaatggcgggggcaaggccaaggtcggagtcttgcgtcaagccaatctctacaagatcaatttgctgccttggaaaaagaactgggcaatctcaacatttgcaccttaagcagcgattcctggtctaaggattggacttataccgttccctacaccctgagaaaaataagcactacctatatcgg

SEQ ID NO: 30 - protein, 692 aa, Alcaligenes faecalis
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAVRDCFGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEINDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYI

SEQ ID NO: 31 - DNA, 438 bp, Alcaligenes faecalis
atgactgctaaagatattgcaactgaagaaagcaagattcgggcttatgcacaatggatagaaattaccatattcgttgttaactcaaacttcaaagtagaaggggcttatctgaagtggggaaagttccatgtaccaggagataaagacaaggaaataactcccagccaaattaatggcaccattatcaaagacgaagactcatacaccattgcctcctgcggacgcgagaacgcctcgtcaggaactgaaggaggtttctccctgtacgacggtgataaattagttttcgaatattactgggattgcccctggagtggttccaacagtgatgaactcaccgtaaaggataaagaaaactacacagtgagtaaaaaaggtggcggtagcccaagtggcgcaacaggcaatatcttcattactgtcgtaaaaaaatcc

SEQ ID NO: 32 - protein, 146 aa, Alcaligenes faecalis
MTAKDIATEESKIRAYAQWIEITIFVVNSNFKVEGAYLKWGKFHVPGDKDKEITPSQINGTIIKDEDSYTIASCGRENASSGTEGGFSLYDGDKLVFEYYWDCPWSGSNSDELTVKDKENYTVSKKGGGSPSGATGNIFITVVKKS

SEQ ID NO: 33 - DNA, 2050 bp, Alcaligenes faecalis
atggacatagaagctaaatccatcaacccattactgggaatcacagttggatctactgttcttgggaatgatttcaaaccttcagttctgataaatccaattaccagaatgattacccaaaaagaaattgaaatgggtatgagtggtaaaagccaatatgtctatactgactccttgaacgagggaaccattggcttttcaggagcctatggcccctcggggatcgccaagtttacgtcagcagttgctgtatccgtcagcaatgcgactgcttcggagtacaagtctattaaagtttcctacaacatttccatgatctcgggaatagaatacatagactttgacaacctgacggtagaagacgtattaaattccttaagcgcaggacctaaaaatctttcgttaaaggttttagagaaatttattgctgcccgtgactgcagtggatcgtctacagaaaaagacgagctcatgaaagaatgggtcaaatctctgcagaacttcatttcatcctacggggatggcctggtcgttggagccatctggggtgggatgggctctgtttctacggagatgacgagcaaaaaatcagaagacagctggaagtatggagaaacggctgaattcagctattcagggataggaagttccgtatccatagcgcaaacctataatggctctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgcctatgcaaagttcagtaagccctcctccaaaaatccctgattttctcaaaccggaaaaaaatgaaggggtaacggaaaagctggatactattaaaaagctgggtgattctgaagagttctcgctcgcgtccggatatgaagaagccaaaaaaacgaacccgaatttaacgtttgaagaattcaaatcaacagttcgggacaagaacaatattgatggcttaaacgacctggcctccaaagtacaggaaaactcattggacgtgttagcagaaggaagcgtctccagaaggaagaagaacatctcgcttcaaggggtcagagcaagcagtttggactcaagctcagactacgccgttctaggcgcctggatagcaaactggtcagatattttcccatggatgtcgatgggatacatgaacgaaatcaacgatgctgaagtggccgagtacatcctgaaaattcgttgcatgatgcaagatttgtccaccttgaacactatttacaatacctttaacgcttgcaatatcaagctggatttctgccatcttaattcagcgtctcaagtagccgattcgttcaaaattgcacagggtgtattgagcgacaacgtagagagtgacgatgcggtggaaatcgcattcaactccttaagcgatgaagccaagaagatttataccgcctggaacgaaattggtttcttgcgtaatgcggagcttggtctgggcctgctcattggggaccagtcagtaagcagtgaaattatcgacgttaagccgataccatatcccgaggtgacctacaaggctgcttattgcagctatgggagcaacaatccgactgcgtttagctcgttcataaaaatgctcccattcattgatacgaatggtgatatttatgccttcgggccgtccctgatgctattgcgaaaagccttgcctgaaaaaatgattttcaccaaaggcggcgaaatggcaatgaagctaacggctgataaagacaaagggattctgactaacgacagtgtcaggttgatacctattccatactctgccgccaagggagttcaatggcggggtcaaggccagggccggagtcttgcgtcaagccaatctctacaagatcaatttgccgccttggaaaaagaactgggcaatctcaacatttgcaccttaagcagcgattcctggtctaaggattggacttataccgttccctacactc

SEQ ID NO: 34 - protein, 683 aa, Alcaligenes faecalis
MDIEAKSINPLLGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSTEKDELMKEWVKSLQNFISSYGDGLVVGAIWGGMGSVSTEMTSKKSEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNEGVTEKLDTIKKLGDSEEFSLASGYEEAKKTNPNLTFEEFKSTVRDKNNIDGLNDLASKVQENSLDVLAEGSVSRRKKNISLQGVRASSLDSSSDYAVLGAWIANWSDIFPWMSMGYMNEINDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGSNNPTAFSSFIKMLPFIDTNGDIYAFGPSLMLLRKALPEKMIFTKGGEMAMKLTADKDKGILTNDSVRLIPIPYSAAKGVQWRGQGQGRSLASSQSLQDQFAALEKELGNLNICTLSSDSWSKDWTYTVPYT

SEQ ID NO: 35 - DNA, 438 bp, Alcaligenes faecalis
atgactgctaaagatattgcaactgaagaaagcaaggttcgggcttatgcacaatggatagaaattaccatattcgttgttaactcaaacttcaaagtagaaggrgcytatctgaagtggggaaagttccatgtaccaggagataaagacaaggaaataactcccagccaaattaatggcaccattatcaaagacgaagactcatacaccattgcctcctgcggacgcgagaacgcctcgtcaggaactgaaggaggtttctccctgtacgacggtgataaattagttttcgaatattactgggattgcccctggagtgggtccaacagygatgaactcaccgtaaaggataaagaaaactacacagtgagtaaaaaaggtggcggtagcccaagtggcgcaacaggcaatatcttcattactgtcgtaaaaaaatcc

SEQ ID NO: 36 - protein, 146 aa, Alcaligenes faecalis
MTAKDIATEESKVRAYAQWIEITIFVVNSNFKVEGAYLKWGKFHVPGDKDKEITPSQINGTIIKDEDSYTIASCGRENASSGTEGGFSLYDGDKLVFEYYWDCPWSGSNSDELTVKDKENYTVSKKGGGSPSGATGNIFITVVKKS

SEQ ID NO: 37 - DNA, 2075 bp, Alcaligenes faecalis
atggacatagaagctaaatccatcaacccattactgggaatcacagttggatctactgttcttgggaatgatttcaaaccttcagttctgataaatccaattaccagaatgattacccaaaaagaaattgaaatgggtatgagtggtaaaagccaatatgtctatactgactccttgaacgagggaaccattggcttttcaggagcctatggcccctcggggatcgccaagtttacgtcagcagttgctgtatccgtcagcaatgcgactgcttcggagtacaagtctattaaagtttcctacaacatttccatgatctcgggaatagaatacatagactttgacaacctgacggtagaagacgtattaaattccttaagcgcaggacctaaaaatctttcgttaaaggttttagagaaatttattgctgcccgtgactgcactggatcgtctacagaaaaagacgagctcatgaaagaatgggtcaaatctctgcagaacttcatttcatcctacggggatggcctggtcgttggagccatctggggtggaatgggctctgtttctacggagatgacaagcaaaaaatcagaagacagctggaagtatggagaaacggctgaattcagctattcagggataggaagttccgtatccatagcgcaaacctataatggctctcaaaaagatcaaagctctgaagttgaggtatcgtgcaaggctctcgccagtggaggttgcgttgaaagccaggtaaattcctggtttgatgttgttgccaacaaatcctttgccgagatctcaggaattagcctgctggataaagcgccaatgcaaagttcggtaagccctcctccaaaaatccctgattttctcaaaccggaaaaaaatgaagaggtaacggaaaagctggatactattaaaaatctgggtaattctgaagagttctcgctcgcgtccggatatgaagaagccaaaaaaacaaacccgaatttaacgtttgaagaattcaaatcaactgttcgggacaagaacaatattgatggcttaaacgacctggcctccaaagtacaggaaaactcattggacgtgttagcagaaggaagcgtctccagaaggaagaagaacatctcgcttcaaggggtcagagcaagcagtttggattcaagctcagactacgccgttctaggcgcctggatagcaaactggtcagatattttcccatggatgtcgatgggatacatgaacgaaatcaacgatgctgaagtggccgagtacatcctgaaaattcgttgcatgatgcaagatttgtccaccttgaacactatttacaatacctttaacgcttgcaatatcaagctggatttctgccatcttaattcagcgtctcaagtagccgattcgttcaaaattgcacagggtgtattgagcgacaacgtagagagtgacgatgcggtggaaatcgcattcaactccttaagcgatgaagccaagaagatttataccgcctggaacgaaattggtttcttgcgtaacgcggagcttggtctgggcctgctcattggggatcaatcagtgagcagtgaaattatcgacgttaagccgataccgtatcccgaggtgacctacaaggctgcttattgcagctatgggagcaacaatccgactgcgtttagctcgttcataaaaatgctcccattcattgatacgaatggtgatatttatgccttcgggccgtccctgatgctattgcgaaaagccttgcctgaaaaaatgattttcactaaaggcggcgaaatggcaattaagctaacggctgataaagacaaagggattctgactaacgacagtgtcaggttgatacctattccatactctgccgccaagggagttcaatggcggggtcaaggccagggccggagtcttgcgtcaagccaatctctacaagatcaatttgccgccttggaaaaagaattgggcaatctcaacatttgcaccttaagcagcgattcctggtctaaggattggacttataccgttccctacaccctgagaaaaataagcactacctatat

SEQ ID NO: 38 - protein, 691 aa, Alcaligenes faecalis
MDIEAKSINPLLGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCTGSSTEKDELMKEWVKSLQNFISSYGDGLVVGAIWGGMGSVSTEMTSKKSEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNEEVTEKLDTIKNLGNSEEFSLASGYEEAKKTNPNLTFEEFKSTVRDKNNIDGLNDLASKVQENSLDVLAEGSVSRRKKNISLQGVRASSLDSSSDYAVLGAWIANWSDIFPWMSMGYMNEINDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGSNNPTAFSSFIKMLPFIDTNGDIYAFGPSLMLLRKALPEKMIFTKGGEMAIKLTADKDKGILTNDSVRLIPIPYSAAKGVQWRGQGQGRSLASSQSLQDQFAALEKELGNLNICTLSSDSWSKDWTYTVPYTLRKISTTY

SEQ ID NO: 39 - DNA, 438 bp, Artificial Sequence
  AfIP-1A-31 variant
atgactgctaaagatattgcaactgaagaaagcaagattcgggcttatgcgcaatggatagaaattgccttattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 40 - protein, 146 aa, Artificial Sequence
  AfIP-1A-31 variant
MTAKDIATEESKIRAYAQWIEIALFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 41 - DNA, 438 bp, Artificial Sequence
  AfIP-1A-31 variant
atgactgctaaagatattgcaactggagaaagcaagattcgggcttatgcgcaatggatagaaattaccatattcgttgttaactcaagcttcaaagtagaaggtgcttatctgaggtggggaaagttccatgtgccaggagataaagacaaggaaataagtcccagcgagatcgagggcaccgtcatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 42 - protein, 146 aa, Artificial Sequence
  AfIP-1A-31 variant
MTAKDIATGESKIRAYAQWIEITIFVVNSSFKVEGAYLRWGKFHVPGDKDKEISPSEIEGTVIKDEDSYTIASCGRENASSGTEGGFSLYDGDKLVFEYYWDCPWSGSNSDELTVKDKENYTVIKKGGGSPSGATGNIFITVVKKS

SEQ ID NO: 43 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaagcttcaaagtagaaggtgcttatctgaggtggggaaagttccatgtgccaggagataaagacaaggaaataagtcccagccagatcgagggcaccgtcatcaaagacgaagagagctacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 44 - protein, 146 aa, Artificial Sequence
  AfIP-1A-31 variant
MTAKDIATEESKIRAYAQWIEITIFVVNSSFKVEGAYLRWGKFHVPGDKDKEISPSQIEGTVIKDEESYTIASCGRENASSGTEGGFSLYDGDKLVFEYYWDCPWSGSNSDELTVKDKENYTVIKKGGGSPSGATGNIFITVVKKS

SEQ ID NO: 45 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagtaccatgtgccaggagataaagacaaggaaataagtcccagcgaggtcgagggcaccatcatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 46 - protein, 146 aa, Artificial Sequence
  AfIP-1A-31 variant
MTAKDIATEESKIRAYAQWIEITIFVVNSNFKVEGAYLRWGKYHVPGDKDKEISPSEVEGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 47 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaagcttcaaagtagaaggtgcttatctgaggtggggaaagttccatgtgccaggagataaagacaaggaaataagtcccagccaaattaatggcaccattatcgaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcagcgttaaggagaaagaaaaatacacagtgattaaaaaaggtggcggtagcccaagtggcgcgacaggcaatatcttcattactgttgtcaaaaaatcc

SEQ ID NO: 48 - protein, 146 aa, Artificial Sequence
  AfIP-1A-31 variant
MTAKDIATEESKIRAYAQWIEITIFVVNSSFKVEGAYLRWGKFHVPGDKDKEISPSQINGTIIEDEDSYTIASCGRENASSGTEGGFSLYDGDKLVFEYYWDCPWSGSNSDELSVKEKEKYTVIKKGGGSPSGATGNIFITVVKKS

SEQ ID NO: 49 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagcgaggtcaacggcaccattatcaaagacgaagactcatacaccattgcctcctgcggacgcgagaacgccccgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 50 - protein, 158 aa, Artificial Sequence
  AfIP-1A-31 variant
AFIPAVARIANTMTAKDIATEESKIRAYAQWIEITIFVVNSNFKVEGAYLRWGKFHVPGDKDKEISPSEVNGTIIKDEDSYTIASCGRENAPSGTEGGFSLYDGDKLVFEYYWDCPWSGSNSDELTVKDKENYTVIKKGGGSPSGATGNIFITVVKKS

SEQ ID NO: 51 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggaaacaaagacaaggaaataagtcccagccaaattaatggcaccattatcaaagacgaagactcatacaccattgccgcctgcggacgcgagaacgcctcgtcaggaactgaaggaggtttctccctgtacgacggtgataaattagtttttgaatattactgggattgcccctggagtggttccaacagcaacgagctcaccgttaaggataaagaaaactacacagtgattaaaaaaggtggcggtagcccaagtggcgcgacaggcaatatcttcattactgttgtcaaaaaatcc

SEQ ID NO: 52 - protein, 146 aa, Artificial Sequence
  AfIP-1A-31 variant
MTAKDIATEESKIRAYAQWIEITIFVVNSNFKVEGAYLRWGKFHVPGNKDKEISPSQINGTIIKDEDSYTIAACGRENASSGTEGGFSLYDGDKLVFEYYWDCPWSGSNSNELTVKDKENYTVIKKGGGSPSGATGNIFITVVKKS

SEQ ID NO: 53 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaaatagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattaatttttgaatattactgggatagcccctggagtggttccaacagcgatgagctcaccgttaaggataaagaaaactacacagtgattaaaaaaggtggcggtagcccaagtggcccgacaggcaatatcttcattactgttgtcaaaaaatcc

SEQ ID NO: 54 - protein, 146 aa, Artificial Sequence
  AfIP-1A-31 variant
MTAKDIATEESKIRAYAQWIEITIFVVNSNFKIEGAYLRWGKFHVPGDKDKEISPSQINGTIIKDEDSYTIASCGRENASSGTEGGFSLYDGDKLIFEYYWDSPWSGSNSDELTVKDKENYTVIKKGGGSPSGPTGNIFITVVKKS

SEQ ID NO: 55 - DNA, 438 bp, Artificial Sequence
  AfIP-1A-31 variant
atgactgctaaagatattgcaactgaagaaagcaagattcgggcttatgcgcaatgggttgaaattaccctgttcgttgttaactcaaacttcaaaattgaaaacgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcccgacaggcaatatcttcattactgttgtcaaaaaatcc

SEQ ID NO: 56 - protein, 146 aa, Artificial Sequence
  AfIP-1A-31 variant
MTAKDIATEESKIRAYAQWVEITLFVVNSNFKIENAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGPTGNIFITVVKKS

SEQ ID NO: 57 - DNA, 438 bp, Artificial Sequence
  AfIP-1A-31 variant
atgactgctaaagatattgcaactgaagaaagcaagattcgggcttatgcgcaatggattgaaattaccctgttcgttgttaactcaaacttcaaagtagaaggtgcttatctgaggtggggaaagttccatgtgccaggagataaagacaaggaaataagtcccagccaagttaatggcaccattatcaaagacgaagactcatacaccattgccgcctgcggacgcgagaacgcctcgtcaggaactgaaggaggtttctccctgtacgacggtgataaattagtttttgaatattactgggattgcccctggagtggctccaacagcgatgagctcaccgttaaggataaagaaaactacacagtgattaaaaaaggtggcggtagcccaagtggcgcgacaggcagtatcttcattactgttgtcaaaaaatcc

SEQ ID NO: 58 - protein, 146 aa, Artificial Sequence
  AfIP-1A-31 variant
MTAKDIATEESKIRAYAQWIEITLFVVNSNFKVEGAYLRWGKFHVPGDKDKEISPSQVNGTIIKDEDSYTIAACGRENASSGTEGGFSLYDGDKLVFEYYWDCPWSGSNSDELTVKDKENYTVIKKGGGSPSGATGSIFITVVKKS

SEQ ID NO: 59 - DNA, 438 bp, Artificial Sequence
  AfIP-1A-31 variant
atgactgctaaagatactgtgactgaagaaagcaagattcgggcttatgcgcaatggatagaaattaccatattcgttgttaactcaagcttcaaagtagaaggtgcttatctgaggtggggaaagttccatgtgccaggagataaagacaaggaaataagtcccagccaaattgaaggcaccgttatcaaagacgaagagtcatacaccattgcctcctgcggacgcgagaacgcctcgtcaggaactgaaggaggtttctccctgtacgacggtgataaattagtttttgaatattactgggattgcccctggagtggttccaacagcgatgagctcagcgttaaggagaaagaaaactacacagtgattaaaaaaggtggcggtagcccaagtggcgcgacaggcaatatcttcattactgttgtcaaaaaatcc

SEQ ID NO: 60 - protein, 146 aa, Artificial Sequence
  AfIP-1A-31 variant
MTAKDTVTEESKIRAYAQWIEITIFVVNSSFKVEGAYLRWGKFHVPGDKDKEISPSQIEGTVIKDEESYTIASCGRENASSGTEGGFSLYDGDKLVFEYYWDCPWSGSNSDELSVKEKENYTVIKKGGGSPSGATGNIFITVVKKS

SEQ ID NO: 61 - DNA, 438 bp, Artificial Sequence
  AfIP-1A-31 variant
atgaccgctaaagatatcgctaccgaggagagcaagattcgtgcttacgcgcagtgggttgagattaccctgttcgttgtgaactccagcttcaaaatcgaaggtgcttatctgcgttggggtaagttccatgtgccaggcgacaaagacaaggagatcagccctagccagatcaatggcactatcatcgaggacgaagactcctacaccattgcctcttgtggtcgcgagaatgctagctctggtactgaaggtggcttcagcctgtatgatggtgacaaactggtgtttgagtactactgggattgcccatggtctggttccaacagcgatgagctgagcgttaaggagaaggagaactacaccgtgatcaagaagggtggtggttctccatctggcccaactggcaatatcttcattactgttgtcaagaagtcc

SEQ ID NO: 62 - protein, 146 aa, Artificial Sequence
  AfIP-1A-31 variant
MTAKDIATEESKIRAYAQWVEITLFVVNSSFKIEGAYLRWGKFHVPGDKDKEISPSQINGTIIEDEDSYTIASCGRENASSGTEGGFSLYDGDKLVFEYYWDCPWSGSNSDELSVKEKENYTVIKKGGGSPSGPTGNIFITVVKKS

SEQ ID NO: 63 - DNA, 438 bp, Artificial Sequence
  AfIP-1A-31 variant
atgactgctaaagatactgtgactgaagaaagcaagattcgggcttatgcgcaatgggtggaaattaccctgttcgttgttaactcaagcttcaaaatcgaaggtgcttatctgaggtggggaaagttccatgtgccaggagataaagacaaggaaataagtcccagcgaaattgaaggcaccgttatcaaagacgaagagtcatacaccattgccgcctgcggacgcgagaacgcctcgtcaggaactgaaggaggtttctccctgtacgacggtgataaattagtttttgaatattactgggattgcccctggagtggttccaacagcaatgagctcagcgttaaggagaaagaaaactacacagtgattaaaaaaggtggcggtagcccaagtggcgcgacaggcagcatcttcattactgttgtcaaaaaatcc

SEQ ID NO: 64 - protein, 146 aa, Artificial Sequence
  AfIP-1A-31 variant
MTAKDTVTEESKIRAYAQWVEITLFVVNSSFKIEGAYLRWGKFHVPGDKDKEISPSEIEGTVIKDEESYTIAACGRENASSGTEGGFSLYDGDKLVFEYYWDCPWSGSNSNELSVKEKENYTVIKKGGGSPSGATGSIFITVVKKS

SEQ ID NO: 65 - DNA, 438 bp, Artificial Sequence
  AfIP-1A-31 variant
atgactgctaaagataccgtaactgaagaaagcaagattcgggcttatgcgcaatgggtagaaattgccttattcgttgttaactcatccttcaaaatagaaggtgcttatctgaggtggggaaagtaccatgtgccaggaaataaagacaaggaaataagtcccagcgaagttgaaggcaccgttatcaaagacgaagaatcatacaccattgccgcctgcggacgcgagaacgcctcgtcaggaactgaaggaggtttctccctgtacgacggtgataaattagtttttgaatattactgggattgcccctggagtggttccaacagcaatgagctctccgttaaggaaaaagaaaactacacagtgattaaaaaaggtggcggtagcccaagtggcgcgacaggcaatatcttcattactgttgtcaaaaaatcc

SEQ ID NO: 66 - protein, 146 aa, Artificial Sequence
  AfIP-1A-31 variant
MTAKDTVTEESKIRAYAQWVEIALFVVNSSFKIEGAYLRWGKYHVPGNKDKEISPSEVEGTVIKDEESYTIAACGRENASSGTEGGFSLYDGDKLVFEYYWDCPWSGSNSNELSVKEKENYTVIKKGGGSPSGATGNIFITVVKKS

SEQ ID NO: 67 - DNA, 438 bp, Artificial Sequence
  AfIP-1A-31 variant
atgactgctaaagataccgtaactgaagaaagcaagattcgggcttatgcgcaatgggtagaaattaccttattcgttgttaactcatccttcaaaatagaaggtgcttatctgaggtggggaaagtaccatgtgccaggaaataaagacaaggaaataagtcccagcgaagttgaaggcaccgttatcaaagacgaagaaacatacaccattgccgcctgcggacgcgagaacgcctcgtcaggaactgaaggaggtttctccctgtacgacggtgataaattaatttttgaatattactgggattgcccctggagtggttccaacagcaatgagctctccgttaaggaaaaagaaaactacacagtgattaaaagaggtggcggtagcccaagtggcgcgacaggcaatatcttcattactgttgtcaaaaaatcc

SEQ ID NO: 68 - protein, 146 aa, Artificial Sequence
  AfIP-1A-31 variant
MTAKDTVTEESKIRAYAQWVEITLFVVNSSFKIEGAYLRWGKYHVPGNKDKEISPSEVEGTVIKDEETYTIAACGRENASSGTEGGFSLYDGDKLIFEYYWDCPWSGSNSNELSVKEKENYTVIKRGGGSPSGATGNIFITVVKKS

SEQ ID NO: 69 - DNA, 438 bp, Artificial Sequence
  AfIP-1A-31 variant
atgactgctaaagatactgtgactggtgaaagcaagattcgggcttatgcgcaatgggtggaaattaccctgttcgttgttaactcaagcttcaaaatcgaaaatgcttatctgaggtggggaaagtaccatgtgccaggaaacaaagacaaggaaataagtcccagcgaagttgaaggcaccgttatcaaagacgaagagtcatacaccattgccgcctgcggacgcgagaacgccccgtcaggaactgaaggaggtttctccctgtacgacggtgataaattagtttttgaatattactgggattgcccctggagtggttccaacagcaatgagctcagcgttaaggagaaagaaaactacacagtgattaaaaaaggtggcggtagcccaagtggcccgacaggcagcatcttcattactgttgtcaaaaaatcc

SEQ ID NO: 70 - protein, 146 aa, Artificial Sequence
  AfIP-1A-31 variant
MTAKDTVTGESKIRAYAQWVEITLFVVNSSFKIENAYLRWGKYHVPGNKDKEISPSEVEGTVIKDEESYTIAACGRENAPSGTEGGFSLYDGDKLVFEYYWDCPWSGSNSNELSVKEKENYTVIKKGGGSPSGPTGSIFITVVKKS

SEQ ID NO: 71 - DNA, 438 bp, Artificial Sequence
  AfIP-1A-31 variant
atgaccgctaaagataccgttaccggcgagagcaagattcgtgcttacgcgcagtgggttgagattgccctgttcgttgtgaactccagcttcaaaatcgaaggtgcttatctgcgttggggtaagtaccatgtgccaggcaacaaagacaaggagatcagccctagcgaggtcgaaggcactgtcatcaaggacgaagagtcctacaccattgccgcttgtggtcgcgagaatgctccatctggtactgaaggtggcttcagcctgtatgatggtgacaaactggtgtttgagtactactgggattgcccatggtctggttccaacagcaatgagctgagcgttaaggagaaggagaactacaccgtgatcaagaagggtggtggttctccatctggcccaactggcagcatcttcattactgttgtcaagaagtcc

SEQ ID NO: 72 - protein, 146 aa, Artificial Sequence
  AfIP-1A-31 variant
MTAKDTVTGESKIRAYAQWVEIALFVVNSSFKIEGAYLRWGKYHVPGNKDKEISPSEVEGTVIKDEESYTIAACGRENAPSGTEGGFSLYDGDKLVFEYYWDCPWSGSNSNELSVKEKENYTVIKKGGGSPSGPTGSIFITVVKKS

SEQ ID NO: 73 - DNA, 438 bp, Artificial Sequence
  AfIP-1A-31 variant
atgactgctaaagataccgtaactggagaaagcaagattcgggcttatgcgcaatgggtagaaattgccttattcgttgttaactcatccttcaaaatagaaggtgcttatctgaggtggggaaagtaccatgtgccaggaaataaagacaaggaaataagtcccagcgaagttgaaggcaccgttatcaaagacgaagaaacatacaccattgccgcctgcggacgcgagaacgcctcgtcaggaactgaaggaggtttctccctgtacgacggtgataaattaatttttgaatattactgggattgcccctggagtggttccaacagcaatgagctctccgttaaggaaaaagaaaactacacagtgattaaaagaggtggcggtagcccaagtggcgcgacaggcaatatcttcattactgttgtcaaaaaatcc

SEQ ID NO: 74 - protein, 146 aa, Artificial Sequence
  AfIP-1A-31 variant
MTAKDTVTGESKIRAYAQWVEIALFVVNSSFKIEGAYLRWGKYHVPGNKDKEISPSEVEGTVIKDEETYTIAACGRENASSGTEGGFSLYDGDKLIFEYYWDCPWSGSNSNELSVKEKENYTVIKRGGGSPSGATGNIFITVVKKS

SEQ ID NO: 75 - DNA, 2108 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagacaaattcattgctgcccgtgactgctctggatcgtctatagaaaaagaggagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggagaccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagagtcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgg

SEQ ID NO: 76 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLDKFIAARDCSGSSIEKEELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLETIKKLGDSEEFALASGYEEAKKTNPNLTFEEFKSTVRDKNNIDGLNELASKVQENSLDVLAEGSISRRNKNLSLQGVRTISLESSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 77 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagacaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggagaccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagatagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 78 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLDKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLETIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVDSDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 79 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgacttcagctattcagggataggaagttccgtatccatagcgcaaacctataatggatctcaaaaagatcaaagctctgatgttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgacgaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacgccctgagaaaaataagcactacctatatcggaaccgttgagaaaatcaacagtatatttgga

SEQ ID NO: 80 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETADFSYSGIGSSVSIAQTYNGSQKDQSSDVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFDEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYALRKISTTYIGTVEKINSIFG

SEQ ID NO: 81 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagacaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgacttcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgacgaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagagtcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgaagaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 82 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLDKFIAARDCSGSSIEKDELMKEWVKSLQNFISSYGDGLVVGAIWGGMGSVSTEMTSKKTEDSWKYGETADFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFDEFKSTVRDKNNIDGLNELASKVQENSLDVLAEGSISRRNKNLSLQGVRTISLESSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSEEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 83 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctattgtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggcagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgatgttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 84 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYCPSGIAKFTSAVAVSVSNATASEYKSIKVSYNISMISGIEYIDFDNLTAEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSDVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 85 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccgtctggggtggaatgggctctgtttctacggagatgacgagcaaaaaaacagaagacagctggaagtatggagaaacggctgaattcagctattcagggataggaccttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgacgaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 86 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAVWGGMGSVSTEMTSKKTEDSWKYGETAEFSYSGIGPSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYDEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 87 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagacattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctgcaattatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgacgaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagcttcggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 88 - protein, 703 aa, Artificial Sequence
  AfIP-1B-32 variant
MDIEAKSINPLMGITVGSTVLGNDFKPSVLINPITRMITQKDIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSCNYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYDEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 89 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagatgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgacctggcatccaaagtccaggaaaattcattggatgtgctagcagaaggcagcatttccagaaggaataaaaacctctcgcttcaaggggttagaacaatcagcttagattcaagctcagacttcgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgataaaatcaacagtatatttgga

SEQ ID NO: 90 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNDLASKVQENSLDVLAEGSISRRNKNLSLQGVRTISLDSSSDFAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVDKINSIFG

SEQ ID NO: 91 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgaaaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggagttagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagacttcgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagcttcggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattttctgccgccaagggaatccaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 92 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFENLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGVSLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDFAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 93 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtggttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 94 - protein, 146 aa, Artificial Sequence
  AfIP-1A-31 variant
MTAKDIATEESKIRAYAQWIEITIFVVNSNFKVEGGYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 95 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccatcaaggataaagaaaactacacagtgattaaaaaaggtggcggtagcccaagtggcgcgacaggcaatatcttcattactgttgtcaaaaaatcc

SEQ ID NO: 96 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTIKDKENYTVIKKGGGSPSGATGNIFITVVKKS

SEQ ID NO: 97 - DNA, 438 bp, Artificial Sequence
  AfIP-1A-31 variant
atgactgctaaagatattgcaactgaagaaagcaagattcgggcttatgcgcaatggatggaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatgttcattactgttgtcaaaaaatcc

SEQ ID NO: 98 - protein, 146 aa, Artificial Sequence
  AfIP-1A-31 variant
MTAKDIATEESKIRAYAQWMEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNMFITVVKKS

SEQ ID NO: 99 - DNA, 438 bp, Artificial Sequence
  AfIP-1A-31 variant
atgactgctaaagatattgcaactgaagaaagcaagattcgggcttatgcgcaatggatggaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgatgggcaatatcttcattactgttgtcaaaaaatcc

SEQ ID NO: 100 - protein, 146 aa, Artificial Sequence
  AfIP-1A-31 variant
MTAKDIATEESKIRAYAQWMEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGAMGNIFITVVKKS

SEQ ID NO: 101 - DNA, 2601 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagggtggcggagccagcggtggtggtgcgtccggcggcggtgcgagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 102 - protein, 867 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASGGGASGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 103 - DNA, 2646 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagggaggtggagcaagtgggggtggcgccagcggcggtggtgcctccggcgggggtgcatcgggtggaggcgcctctggcggtggtgcgagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 104 - protein, 882 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASGGGASGGGASGGGASGGGASGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 105 - DNA, 2610 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgaggggggtggtgcatctttatctcagtctctctcccagtccggaggtggggcaagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 106 - protein, 870 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASLSQSLSQSGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 107 - DNA, 2670 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagggtggcggcgctagcggggggggcgcaagtggtggtggggcttcattaagtcagagcctgtctcaatctggcggcggtgcttccggcggcggtgcctcggggggtggagcgagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 108 - protein, 890 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASGGGASGGGASLSQSLSQSGGGASGGGASGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 109 - DNA, 2625 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagggtggcggagccagcggtggtggtgcgtccggcggcggtgcgagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttggactcgagcaccaccaccaccaccac

SEQ ID NO: 110 - protein, 876 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASGGGASGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFGGLEHHHHHH

SEQ ID NO: 111 - DNA, 2694 bp, Artificial Sequence
  fusion protein
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagggtggcggcgctagcggggggggcgcaagtggtggtggggcttcattaagtcagagcctgtctcaatctggcggcggtgcttccggcggcggtgcctcggggggtggagcgagccatatggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttggactcgagcaccaccaccaccaccac

SEQ ID NO: 112 - protein, 899 aa, Artificial Sequence
  fusion protein
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEGGGASGGGASGGGASLSQSLSQSGGGASGGGASGGGASHMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFGGLEHHHHHH

SEQ ID NO: 113 - protein, 18 aa, Artificial Sequence
  fusion linker
LEGGGASGGGASGGGASH

SEQ ID NO: 114 - protein, 21 aa, Artificial Sequence
  fusion linker
LEGGGASLSQSLSQSGGGASH

SEQ ID NO: 115 - protein, 33 aa, Artificial Sequence
  fusion linker
LEGGGASGGGASGGGASGGGASGGGASGGGASH

SEQ ID NO: 116 - protein, 41 aa, Artificial Sequence
  fusion linker
LEGGGASGGGASGGGASLSQSLSQSGGGASGGGASGGGASH

SEQ ID NO: 117 - protein, 18 aa, Artificial Sequence
  fusion linker
LEGGGASGGGASGGGASH

SEQ ID NO: 118 - protein, 41 aa, Artificial Sequence; identical to SEQ ID NO: 116
  fusion linker

SEQ ID NO: 119 - protein, 119 aa, Bacillus thuringiensis
MSAREVHIEINNKTRHTLQLEDKTKLSGGRWRTSPTNVARDTIKTFVAESHGFMTGVEGIIYFSVNGDAEISLHFDNPYIGSNKCDGSSDKPEYEVITQSGSGDKSHVTYTIQTVSLRL

SEQ ID NO: 120 - protein, 123 aa, Bacillus thuringiensis
MSAREVHIDVNNKTGHTLQLEDKTKLDGGRWRTSPTNVANDQIKTFVAESNGFMTGTEGTIYYSINGEAEISLYFDNPFAGSNKYDGHSNKSQYEIITQGGSGNQSHVTYTIQTTSSRYGHKS

SEQ ID NO: 121 - protein, 123 aa, Bacillus thuringiensis
MSAREVHIDVNNKTGHTLQLEDKTKLDGGRWRTSPTNVANDQIKTFVAESHGFMTGTEGTIYYSINGEAEISLYFDNPYSGSNKYDGHSNKNQYEVITQGGSGNQSHVTYTIQTVSSRYGNNS

SEQ ID NO: 122 - protein, 123 aa, Bacillus thuringiensis
MSAREVHINVNNKTGHTLQLEDKTKLDGGRWRTSPTNVANDQIKTFVAESHGFMTGTEGHIYYSINGEAEISLYFDNPYSGSNKYDGHSNKPQYEVTTQGGSGNQSHVTYTIQTASSRYGNNS

SEQ ID NO: 123 - protein, 387 aa, Bacillus thuringiensis
MIETNKIYEISNKANGLYATTYLSFDNSGVSLLNKNESDINDYNLKWFLFPIDNNQYIITSYGVNKNKVWTANGNKINVTTYSAENSAQQWQIRNSSSGYIIENNNGKILTAGTGQSLGLLYLTDEIPEDSNQQWNLTSIQTISLPSQPIIDTTLVDYPKYSTTGSINYNGTALQLMGWTLIPCIMVYDKTIASTHTQITTTPYYILKKYQRWVLATGSGLSVPAHVKSTFEYEWGTDTDQKTSVINTLGFQINTDTKLKATVPEVGGGTTDIRTQITEELKVEYSSENKEMRKYKQSFDVDNLNYDEALNAVGFIVETSFELYRMNGNVLITSIKTTNKDTYNTVTYPNHKEVLLLLTNHSYEEVTALTGISKERLQNLKNNWKKR

SEQ ID NO: 124 - protein, 152 aa, Aspergillus terreus
MDDSQWVSIHIRDRLAQGNITIRESFLYDCSRSGLPLLFRGQFHSPEDEKKALTEDDIDQLIIPSEGIGEVCARGRRGSEGWMDLFDGEKKICELHWDNRTKRPSNEFEVIDGDKDYKIECSGWSPQAGPLGHVFIDISAAKKKAAAAAAAK

SEQ ID NO: 125 - protein, 139 aa, Neosartorya fischeri
MASTTGQQYLDIEIKDDMKYDIRIENAHIESGEFYREGDQNDTLTTDDIEDMIIRHNGGLRHVCSCGEEKGFKGLQGTIDLIDDVKDARICTLAWNAPMEPGKRNTFMLRDQDPRYNINIGKWNESGILGRVPVTISDE

SEQ ID NO: 126 - protein, 139 aa, Aspergillus clavatus
MAPTSAHQYLDMEIKDDMQYDIRIENARIDSGEFHSASDENDTLTTDDVEDLMIRHNGGTRHVCSSGEEEGFKGLQGTIDLVDDVRDARICTLAWNAPMEPGKRNLLMMHHHDPQYNVEIGKWNESGVMGTVPITISNQ

SEQ ID NO: 127 - protein, 145 aa, Aspergillus niger
MAERAEAQWVHIRVVNSLSFDTLSVRNTWLGWGKFHKENNKSAEIPVSDINALRAAPGGSFNVFACGRAHSPSGTEGSFDVYNGDVRVAYIYWDCPWGSKRNQFRVDRIADDYWVETGYWNQSGGAIGSVTVEIGRRDRAIRSSL

SEQ ID NO: 128 - protein, 142 aa, Aspergillus niger
MPAAGPMDDQWVSFHIRDHLEKGEITVRHTVIEGGEFHDPNNRRQSLTEDEIDEITIPSYGIGEICARGRRGSEGRLDLFHDEEKICELHWDNRQGNPVNIVEMLDSNSKYRVEHGGWSPEAGPLGHVYIDILEQQKKKNSK

SEQ ID NO: 129 - protein, 132 aa, Bacillus thuringiensis
MSAREVHIEIINHTGHTLQMDKRTRLAHGEWIITPVNVPNNSSDLFQAGSDGVLTGVEGIIIYTINGEIEITLHFDNPYAGSNKYSGRSSDDDYKVITEARAEHRANNHDHVTYTVQRNISRYTNKLCSNNS

SEQ ID NO: 130 - protein, 121 aa, Pseudomonas aeruginosa
VKVVVSNSIGTAGIRNATLQWGMFCRCSNRDDEISAEKDSSMNVQAGSPQWIASCGRENAASGTRGCFDCHDGNTKMGTFSWDDPRKSGATQTRHFTPASQNYAGISSGGNATGAASARSP

SEQ ID NO: 131 - protein, 136 aa, Pseudomonas aeruginosa
MAYAEWIAVKVVVSKSIGTVGIRNATLQWGKFYRYTNKDDEISTEEVSSMNVQAGSPQWIASCGRENASSGTQGSFDCYDGNTKMGTFSWDDPWKSGATNTWSFTPASADYAGITSGGNATGTDIGEVTLTLGRFS

SEQ ID NO: 132 - protein, 116 aa, Rheum austral
KDEEISANEVNQLRIPAGSDGDIASSGRSDSASGTEGQVDIYDGDTRVCTLYWSCPWGSKANDFQIRNINRDYGITLGDWNRDSGALGKVDVDIFSLWLEDVLGKKLWLQSRSKLT

SEQ ID NO: 133 - protein, 283 aa, Aspergillus oryzae
MPADAYGQYVDIKIEDGMKYDLRIENAHLDSGQFYRQGDQGDIMTADDIDDMIIRHNGGIREVCSCGETDSMSGTQGTIDLIDDVKDTRICTLAWSAPMQSGRKNRFSMLNHDPRYKVDIGKWQESGTMGTVNVAIKDEMALCLCQQSKISGAQELIRLLFDIDLLHLLIDLNIRSRKIPKGNMKRTKKYASQVNGKEIIPGTSQLLETCGRSSAASGTEGTLELWDKTQRICKLYWDCPWGSKVNKFKVQEKYKTYRVEVGPWNSYGGALGNVDVEISRKRA

SEQ ID NO: 134 - protein, 144 aa, Aspergillus oryzae
MALCLCQQSKISGAQELIRLLFDIDLLHLLIDLNIRSRKIPKGNMKRTKKYASQVNGKEIIPGTSQLLETCGRSSAASGTEGTLELWDKTQRICKLYWDCPWGSKVNKFKVQEKYKTYRVEVGPWNSYGGALGNVDVEISRKRA

SEQ ID NO: 135 - protein, 141 aa, Aspergillus oryzae
MDTDLNKYNSKWVEFHIRDHLKDGEISVRHTVIEDGEFQDPNNRRKSIHEDVIDEIVIPSDGIGEICAHGRRGSEGRLDLFHGNDKICELHWDDRDGRRENLVEMLDESDKYRIEHGGWSPEANGPLGHVYVDVWAKDKSK

SEQ ID NO: 136 - protein, 130 aa, Heterobasidion annosum
MAYAQWVIIIIRNVGAAKFSIKNLNPSWGKLHAEGDKDTEVNKSTIEGKVVEADQQLRINACGRSDAAEGTTGSFDLVDVATQQVIRHVYWDCPWGTKRNTFTVSGSNSKWMIEYSGQNLDSGALGTISV

SEQ ID NO: 137 - protein, 153 aa, Clostridium bifermentans
MNNNCEVNCENTEENKSNRAYRQWVKFHIEAVNEGLKIRNASLKWGKFHDPNNKDIPISPEDISKINIEKHDTAIIASSGKENTASGTEGVFYICDENEDKIAAIYWDCPWSGSNKLTIDKYNTKFAIEQSPTMISSSGAIGDVNLKVSKIWA

SEQ ID NO: 138 - protein, 152 aa, Clostridium bifermentans
MNNNCEVNCENTEENKSNRAYRQWVKFHIEAVHSNLKIRNASLTWGKFHDPYNKDIPISPEDISKINIGIGRIEIIASSGKENTASGTEGVFYICDEHEEKIVTVYWDCPWSGSNKFELRDKNPNFIIETYPTMISSSGAIGDVNIRVFRRF

SEQ ID NO: 139 - protein, 145 aa, Agrocybe aegerita
MDSNKDERAYAQWVIIILHNVGSSPFKIANLGLSWGKLYADGNKDKEVYPSDYNGKTVGPDEKIQINSCGRENASSGTEGSFDIVDPNDGNKTIRHFYWECPWGSKRNTWTPSGSNTKWMVEWSGQNLDSGALGTITVDVLRKGN

SEQ ID NO: 140 - protein, 135 aa, Beta vulgaris
MAYAQWVVVHIINSFRNGTISIKDAKAFWGKFYKNGNKDDEIIANEVNQLMIPAGSDGDIASCGRSDSASGTEGQVYVYDGDTRVCTLYWSCPWGSKANNFHIRNINKDYGITPSDWNSDSGALGRVNVDISRKG

SEQ ID NO: 141 - protein, 135 aa, Lolium multiflorum
MAYAQWVVIHIINSFRNGSISIKNAEAMWGKFHKNGNKDAEIGAGEVNKMSVGAGSSEKVSSCGRSDSASGTEGKFDIYDGDNRVCTVYWSCPWGSKSNNFQIQNRNKDYGITLGDWNQDSGALGEVDVDISRKG

SEQ ID NO: 142 - protein, 138 aa, Pleurotus ostreatus
MAYAQWVIIIIHNVGSKDVKIKNLKPSWGKLHADGDKDTEVSASKYEGTVIKPDEKLQINACGRSDAAEGTTGTFDLVDPADGDKQVRHFYWDCPWGSKTNTWTVSGSNTKWMIEYSGQNLDSGALGTITVDTLKKGN

SEQ ID NO: 143 - protein, 137 aa, Pleurotus ostreatus
AYAQWVIILIHNVGQQNVKIKNLNASWGKLYADGDKDTEVPASKYEGMVIAPGDQVQINACGREDAAEGTTGTFDLVDPNDSDKQVRHISWDCPWGTKANSWVVGGSNSKWMIEYTGQNLDSGALGTITVNTLKIGN

SEQ ID NO: 144 - protein, 136 aa, Aspergillus nidulans
MTIPAEGLGEVCATGRRGSEGWLDLFDGDKKICELHWDNRAERRWNDFEVLEPDEGYRVECSGWSSERGPLGHVFVDVSEARKEELRREKELGGLRVFEGPGVGEKSVDVDVAEEVPVLGGLGGIGGNITMGGFIS

SEQ ID NO: 145 - protein, 139 aa, Aspergillus funigatus
MASVQAYAQWVTVHLINSMSSETLSIQNASLSWGKWYKDGDKDAEITSEDVQQKTAPPGGSVNVNSCGRSDASSGTTGGFDLYDGNTKIGRVHWDCPWGSKTNDFDVGERNKNYWVEIGTWNKYGGAIGTVDVEVGRKR

SEQ ID NO: 146 - protein, 174 aa, Trametes versicolor
MNFELAHPSRPIAEGICVTEDVRTSEDFVVSDNDDRHRAYAQWVSIEIINYGPRPVKIKNVYRSWGKLYIEGNKDKEVSPSYFENTTINPNGTLTIAGCGRSNASSGTEGGFNIVDPSRGDDIIRSVYWDCPWGSKTNKWSVSGSLSGWDVYDKGANIDSGALGNITIETVYKG

SEQ ID NO: 147 - protein, 138 aa, Moniliophthora perniciosa
MAYAQWVVIVLHNVGNSPMKVKNVSLDWGKFHVDGNKDKEIGKDQIEGKVIGPDEKFQINSCGRSDASSGTEGSFDLVDTKDGDKTIRHCYWECPWGSKTNTWTVNGSNSKWMVEHQGANLYGGALGTITVDAMKKGN

SEQ ID NO: 148 - protein, 96 aa, Bacillus thuringiensis
INNKTRHTLQLEDKTKLTSGRWRTSPTNVARDTIKTFVAESHGFMTGIEGIIYFSVNGEAEISLHFDNPYVGSNKYDGSSDKAAYEVIAQGGSGDI

SEQ ID NO: 149 - DNA, 426 bp, Artificial Sequence
  AfIP-1A-31 variant - codon optimized
atgattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 150 - protein, 142 aa, Artificial Sequence
  AfIP-1A-31 variant
MIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 151 - DNA, 423 bp, Artificial Sequence
  AfIP-1A-31 variant
atggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatccctcgagcaccaccaccaccaccac

SEQ ID NO: 152 - protein, 141 aa, Artificial Sequence
  AfIP-1A-31 variant
MAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKSLEHHHHHH

SEQ ID NO: 153 - protein, 5 aa, Artificial Sequence
  fusion linker
EEKKN

SEQ ID NO: 154 - DNA, 42 bp, Artificial Sequence
  mutagenesis primer
  misc_feature (16)..(16): r is A or G
gcttatgcgcaatggrttgaaattaccatcttcgttgttaac

SEQ ID NO: 155 - DNA, 42 bp, Artificial Sequence
  mutagenesis primer
  misc_feature (16)..(16): r is A or G
gcttatgcgcaatggrttgaaattaccctgttcgttgttaac

SEQ ID NO: 156 - DNA, 36 bp, Artificial Sequence
  mutagenesis primer
  misc_feature (13)..(13): r is A or G
tcaaacttcaaarttgaaaacgcttatctgaggtgg

SEQ ID NO: 157 - DNA, 36 bp, Artificial Sequence
  mutagenesis primer
  misc_feature (13)..(13): r is A or G
tcaaacttcaaarttgaaggtgcttatctgaggtgg

SEQ ID NO: 158 - DNA, 33 bp, Artificial Sequence
  mutagenesis primer
ttccatgtgccaggaaacaaagacaaggaaata

SEQ ID NO: 159 - DNA, 33 bp, Artificial Sequence
  mutagenesis primer
tcatacaccattgccgcctgcggacgcgagaac

SEQ ID NO: 160 - DNA, 33 bp, Artificial Sequence
  mutagenesis primer
gacggtgataaattaatttttgaatattactgg

SEQ ID NO: 161 - DNA, 33 bp, Artificial Sequence
  mutagenesis primer
agtggttccaacagcaacgagctcaccgttaag

SEQ ID NO: 162 - DNA, 33 bp, Artificial Sequence
  mutagenesis primer
ggtagcccaagtggcccgacaggcaatatcttc

SEQ ID NO: 163 - DNA, 33 bp, Artificial Sequence
  mutagenesis primer
ttcgttgttaactcaagcttcaaagtagaaggt

SEQ ID NO: 164 - DNA, 45 bp, Artificial Sequence
  mutagenesis primer
  misc_feature (16)..(16): s is G or C
  misc_feature (19)..(19): r is A or G
  misc_feature (31)..(31): r is A or G
gaaataagtcccagcsagrtcaacggcaccrtcatcaaagacgaa

SEQ ID NO: 165 - DNA, 45 bp, Artificial Sequence
  mutagenesis primer
  misc_feature (16)..(16): s is G or C
  misc_feature (19)..(19): r is A or G
  misc_feature (31)..(31): r is A or G
gaaataagtcccagcsagrtcgagggcaccrtcatcaaagacgaa

SEQ ID NO: 166 - DNA, 33 bp, Artificial Sequence
  mutagenesis primer
  misc_feature (15)..(15): k is G or T
  misc_feature (17)..(17): s is G or C
atcaaagacgaagakasctacaccattgcctcc

SEQ ID NO: 167 - DNA, 51 bp, Artificial Sequence
  mutagenesis primer
  misc_feature (17)..(17): s is G or C
  misc_feature (27)..(27): k is G or T
  misc_feature (36)..(36): m is A or C
aacagcgatgagctcascgttaaggakaaagaaaamtacacagtgattaaa

SEQ ID NO: 168 - DNA, 21 bp, Artificial Sequence
  mutagenesis primer
ttgcgcataagcccgaatctt

SEQ ID NO: 169 - DNA, 45 bp, Artificial Sequence
  mutagenesis primer
  misc_feature (22)..(23): n is a, c, g, or t
  misc_feature (24)..(24): k is G or T
aagattcgggcttatgcgcaannkatagaaattaccatattcgtt

SEQ ID NO: 170 - DNA, 21 bp, Artificial Sequence
  mutagenesis primer
ccattgcgcataagcccgaat

SEQ ID NO: 171 - DNA, 45 bp, Artificial Sequence
  mutagenesis primer
  misc_feature (22)..(23): n is a, c, g, or t
  misc_feature (24)..(24): k is G or T
attcgggcttatgcgcaatggnnkgaaattaccatattcgttgtt

SEQ ID NO: 172 - DNA, 21 bp, Artificial Sequence
  mutagenesis primer
cctcagataagcaccttctac

SEQ ID NO: 173 - DNA, 45 bp, Artificial Sequence
  mutagenesis primer
  misc_feature (22)..(23): n is a, c, g, or t
  misc_feature (24)..(24): k is G or T
gtagaaggtgcttatctgaggnnkggaaagttccatgtgccagga

SEQ ID NO: 174 - DNA, 21 bp, Artificial Sequence
  mutagenesis primer
ccacctcagataagcaccttc

SEQ ID NO: 175 - DNA, 45 bp, Artificial Sequence
  mutagenesis primer
  misc_feature (22)..(23): n is a, c, g, or t
  misc_feature (24)..(24): k is G or T
gaaggtgcttatctgaggtggnnkaagttccatgtgccaggagat

SEQ ID NO: 176 - DNA, 21 bp, Artificial Sequence
  mutagenesis primer
tccccacctcagataagcacc

SEQ ID NO: 177 - DNA, 45 bp, Artificial Sequence
  mutagenesis primer
  misc_feature (22)..(23): n is a, c, g, or t
  misc_feature (24)..(24): k is G or T
ggtgcttatctgaggtggggannkttccatgtgccaggagataaa

SEQ ID NO: 178 - DNA, 21 bp, Artificial Sequence
  mutagenesis primer
ggaggcaatggtgtatgagtc

SEQ ID NO: 179 - DNA, 45 bp, Artificial Sequence
  mutagenesis primer
  misc_feature (22)..(23): n is a, c, g, or t
  misc_feature (24)..(24): k is G or T
gactcatacaccattgcctccnnkggacgcgagaacgcctcgtca

SEQ ID NO: 180 - DNA, 21 bp, Artificial Sequence
  mutagenesis primer
gcaggaggcaatggtgtatga

SEQ ID NO: 181 - DNA, 45 bp, Artificial Sequence
  mutagenesis primer
  misc_feature (22)..(23): n is a, c, g, or t
  misc_feature (24)..(24): k is G or T
tcatacaccattgcctcctgcnnkcgcgagaacgcctcgtcagga

SEQ ID NO: 182 - DNA, 21 bp, Artificial Sequence
  mutagenesis primer
tccgcaggaggcaatggtgta

SEQ ID NO: 183 - DNA, 45 bp, Artificial Sequence
  mutagenesis primer
  misc_feature (22)..(23): n is a, c, g, or t
  misc_feature (24)..(24): k is G or T
tacaccattgcctcctgcggannkgagaacgcctcgtcaggaact

SEQ ID NO: 184 - DNA, 21 bp, Artificial Sequence
  mutagenesis primer
tgacgaggcgttctcgcgtcc

SEQ ID NO: 185 - DNA, 45 bp, Artificial Sequence
  mutagenesis primer
  misc_feature (22)..(23): n is a, c, g, or t
  misc_feature (24)..(24): k is G or T
ggacgcgagaacgcctcgtcannkactgaaggaggtttctccctg

SEQ ID NO: 186 - DNA, 21 bp, Artificial Sequence
  mutagenesis primer
gtaatattcaaaaactaattt

SEQ ID NO: 187 - DNA, 45 bp, Artificial Sequence
  mutagenesis primer
  misc_feature (22)..(23): n is a, c, g, or t
  misc_feature (24)..(24): k is G or T
aaattagtttttgaatattacnnkgattgcccctggagtggttcc

SEQ ID NO: 188 - DNA, 21 bp, Artificial Sequence
  mutagenesis primer
gcaatcccagtaatattcaaa

SEQ ID NO: 189 - DNA, 46 bp, Artificial Sequence
  mutagenesis primer
  misc_feature (22)..(23): n is a, c, g, or t
  misc_feature (24)..(24): k is G or T
tttgaatattactgggattgcnnktggagtggttccaacagcgatg

SEQ ID NO: 190 - DNA, 21 bp, Artificial Sequence
  mutagenesis primer
ggggcaatcccagtaatattc

SEQ ID NO: 191 - DNA, 45 bp, Artificial Sequence
  mutagenesis primer
  misc_feature (22)..(23): n is a, c, g, or t
  misc_feature (24)..(24): k is G or T
gaatattactgggattgccccnnkagtggttccaacagcgatgag

SEQ ID NO: 192 - DNA, 16 bp, Artificial Sequence
  mutagenesis primer
tgggctaccgccacct

SEQ ID NO: 193 - DNA, 37 bp, Artificial Sequence
  mutagenesis primer
  misc_feature (17)..(18): n is a, c, g, or t
  misc_feature (19)..(19): k is G or T
aggtggcggtagcccannkggcgcgacaggcaatatc

SEQ ID NO: 194 - DNA, 17 bp, Artificial Sequence
  mutagenesis primer
acttgggctaccgccac

SEQ ID NO: 195 - DNA, 38 bp, Artificial Sequence
  mutagenesis primer
  misc_feature (18)..(19): n is a, c, g, or t
  misc_feature (20)..(20): k is G or T
gtggcggtagcccaagtnnkgcgacaggcaatatcttc

SEQ ID NO: 196 - DNA, 17 bp, Artificial Sequence
  mutagenesis primer
gccacttgggctaccgc

SEQ ID NO: 197 - DNA, 40 bp, Artificial Sequence
  mutagenesis primer
  misc_feature (18)..(19): n is a, c, g, or t
  misc_feature (20)..(20): k is G or T
gcggtagcccaagtggcnnkacaggcaatatcttcattac

SEQ ID NO: 198 - DNA, 18 bp, Artificial Sequence
  mutagenesis primer
cgcgccacttgggctacc

SEQ ID NO: 199 - DNA, 40 bp, Artificial Sequence
  mutagenesis primer
  misc_feature (19)..(20): n is a, c, g, or t
  misc_feature (21)..(21): k is G or T
ggtagcccaagtggcgcgnnkggcaatatcttcattactg

SEQ ID NO: 200 - DNA, 20 bp, Artificial Sequence
  mutagenesis primer
tgtcgcgccacttgggctac

SEQ ID NO: 201 - DNA, 42 bp, Artificial Sequence
  mutagenesis primer
  misc_feature (21)..(22): n is a, c, g, or t
  misc_feature (23)..(23): k is G or T
gtagcccaagtggcgcgacannkaatatcttcattactgttg

SEQ ID NO: 202 - DNA, 18 bp, Artificial Sequence
  mutagenesis primer
gcctgtcgcgccacttgg

SEQ ID NO: 203 - DNA, 40 bp, Artificial Sequence
  mutagenesis primer
  misc_feature (19)..(20): n is a, c, g, or t
  misc_feature (21)..(21): k is G or T
ccaagtggcgcgacaggcnnkatcttcattactgttgtca

SEQ ID NO: 204 - DNA, 18 bp, Artificial Sequence
  mutagenesis primer
attgcctgtcgcgccact

SEQ ID NO: 205 - DNA, 39 bp, Artificial Sequence
  mutagenesis primer
  misc_feature (19)..(20): n is a, c, g, or t
  misc_feature (21)..(21): k is G or T
agtggcgcgacaggcaatnnkttcattactgttgtcaaa

SEQ ID NO: 206 - DNA, 20 bp, Artificial Sequence
  mutagenesis primer
gatattgcctgtcgcgccac

SEQ ID NO: 207 - DNA, 42 bp, Artificial Sequence
  mutagenesis primer
  misc_feature (17)..(18): n is a, c, g, or t
  misc_feature (19)..(19): k is G or T
cgcgacaggcaatatcnnkattactgttgtcaaaaaatccct

SEQ ID NO: 208 - DNA, 20 bp, Artificial Sequence
  mutagenesis primer
gaagatattgcctgtcgcgc

SEQ ID NO: 209 - DNA, 41 bp, Artificial Sequence
  mutagenesis primer
  misc_feature (17)..(18): n is a, c, g, or t
  misc_feature (19)..(19): k is G or T
gacaggcaatatcttcnnkactgttgtcaaaaaatccctcg

SEQ ID NO: 210 - DNA, 33 bp, Artificial Sequence
  mutagenesis primer
atgattacccaaaaagacattgaaatgggtatg

SEQ ID NO: 211 - DNA, 33 bp, Artificial Sequence
  mutagenesis primer
ctctaccgtcagattttcaaagtcgatatattc

SEQ ID NO: 212 - DNA, 33 bp, Artificial Sequence
  mutagenesis primer
gtcacgggcagcaatatatttctctaaaacctt

SEQ ID NO: 213 - DNA, 33 bp, Artificial Sequence
  mutagenesis primer
attgatggcttgaatgacctggcatccaaagtc

SEQ ID NO: 214 - DNA, 33 bp, Artificial Sequence
  mutagenesis primer
gattcaagctcagacttcgccgttttaggcgcc

SEQ ID NO: 215 - DNA, 33 bp, Artificial Sequence
  mutagenesis primer
gaaatcagtgatgctgacgttgcggagtacatc

SEQ ID NO: 216 - DNA, 33 bp, Artificial Sequence
  mutagenesis primer
tatatcggaaccgttgataaaatcaacagtata

SEQ ID NO: 217 - DNA, 33 bp, Artificial Sequence
  mutagenesis primer
cttgcgtccggatatgacgaagccaaaaaaaca

SEQ ID NO: 218 - DNA, 33 bp, Artificial Sequence
  mutagenesis primer
gcggtagaaatcgcatacaattccttaagcgat

SEQ ID NO: 219 - DNA, 33 bp, Artificial Sequence
  mutagenesis primer
gcagcttattgcagcttcggaaacaacaacccg

SEQ ID NO: 220 - DNA, 33 bp, Artificial Sequence
  mutagenesis primer
ttgatacctattccattttctgccgccaaggga

SEQ ID NO: 221 - DNA, 33 bp, Artificial Sequence
  mutagenesis primer
tcgttaaaggttttagacaaattcattgctgcc

SEQ ID NO: 222 - DNA, 36 bp, Artificial Sequence
  mutagenesis primer
  misc_feature (18)..(18): k is G or T
  misc_feature (21)..(21): k is G or T
tcgtctatagaaaaagakgakctcatgaaagaatgg

SEQ ID NO: 223 - DNA, 33 bp, Artificial Sequence
  mutagenesis primer
aacttcatttcatccttcggggatggtctggtc

SEQ ID NO: 224 - DNA, 33 bp, Artificial Sequence
  mutagenesis primer
tatggagaaacggctgacttcagctattcaggg

SEQ ID NO: 225 - DNA, 33 bp, Artificial Sequence
  mutagenesis primer
aaagatcaaagctctgatgttgaggtatcttgc

SEQ ID NO: 226 - DNA, 33 bp, Artificial Sequence
  mutagenesis primer
ccggaaaaaaatgcagacataacggaaaagctg

SEQ ID NO: 227 - DNA, 33 bp, Artificial Sequence
  mutagenesis primer
ataacggaaaagctggagaccattaaaaagctg

SEQ ID NO: 228 - DNA, 33 bp, Artificial Sequence
  mutagenesis primer
ccgaacttaacttttgacgaattcaaatcaact

SEQ ID NO: 229 - DNA, 33 bp, Artificial Sequence
  mutagenesis primer
agaacaatcagcttagagtcaagctcagactac

SEQ ID NO: 230 - DNA, 32 bp, Artificial Sequence
  mutagenesis primer
  misc_feature (10)..(10): m is A or C
ttaagcgacmcgtagatagtgacgatgcggta

SEQ ID NO: 231 - DNA, 33 bp, Artificial Sequence
  mutagenesis primer
ttcaattccttaagcgaagaagccaagaagatt

SEQ ID NO: 232 - DNA, 33 bp, Artificial Sequence
  mutagenesis primer
gttaagccgataccgtttcccgaggtcacctac

SEQ ID NO: 233 - DNA, 22 bp, Artificial Sequence
  mutagenesis primer
tcccgagatcatggaaatattg

SEQ ID NO: 234 - DNA, 41 bp, Artificial Sequence
  mutagenesis primer
  misc_feature (20)..(21): n is a, c, g, or t
  misc_feature (22)..(22): k is G or T
caatatttccatgatctcgnnkatagaatatatcgactttg

SEQ ID NO: 235 - DNA, 22 bp, Artificial Sequence
  mutagenesis primer
atattctattcccgagatcatg

SEQ ID NO: 236 - DNA, 42 bp, Artificial Sequence
  mutagenesis primer
  misc_feature (20)..(21): n is a, c, g, or t
  misc_feature (22)..(22): k is G or T
catgatctcgggaatagaannkatcgactttgacaatctgac

SEQ ID NO: 237 - DNA, 24 bp, Artificial Sequence
  mutagenesis primer
aacctttaacgaaagatttttagg

SEQ ID NO: 238 - DNA, 41 bp, Artificial Sequence
  mutagenesis primer
  misc_feature (22)..(23): n is a, c, g, or t
  misc_feature (24)..(24): k is G or T
cctaaaaatctttcgttaaagnnkttagagaaattcattgc

SEQ ID NO: 239 - DNA, 23 bp, Artificial Sequence
  mutagenesis primer
gaatttctctaaaacctttaacg

SEQ ID NO: 240 - DNA, 43 bp, Artificial Sequence
  mutagenesis primer
  misc_feature (21)..(22): n is a, c, g, or t
  misc_feature (23)..(23): k is G or T
cgttaaaggttttagagaaannkattgctgcccgtgactgctc

SEQ ID NO: 241 - DNA, 22 bp, Artificial Sequence
  mutagenesis primer
tcccacgaccagaccatccccg

SEQ ID NO: 242 - DNA, 40 bp, Artificial Sequence
  mutagenesis primer
  misc_feature (17)..(18): n is a, c, g, or t
  misc_feature (19)..(19): k is G or T
ggatggtctggtcgtgnnkgccatctggggtggaatgggc

SEQ ID NO: 243 - DNA, 24 bp, Artificial Sequence
  mutagenesis primer
ccagatggctcccacgaccagacc

SEQ ID NO: 244 - DNA, 40 bp, Artificial Sequence
  mutagenesis primer
  misc_feature (22)..(23): n is a, c, g, or t
  misc_feature (24)..(24): k is G or T
ggtctggtcgtgggagccatcnnkggtggaatgggctctg

SEQ ID NO: 245 - DNA, 22 bp, Artificial Sequence
  mutagenesis primer
attttcctggactttggatgcc

SEQ ID NO: 246 - DNA, 40 bp, Artificial Sequence
  mutagenesis primer
  misc_feature (15)..(16): n is a, c, g, or t
  misc_feature (17)..(17): k is G or T
ccaaagtccaggaannktcattggatgtgctagcagaagg

SEQ ID NO: 247 - DNA, 22 bp, Artificial Sequence
  mutagenesis primer
cacatccaatgaattttcctgg

SEQ ID NO: 248 - DNA, 45 bp, Artificial Sequence
  mutagenesis primer
  misc_feature (22)..(23): n is a, c, g, or t
  misc_feature (24)..(24): k is G or T
gtccaggaaaattcattggatnnkctagcagaaggcagcatttcc

SEQ ID NO: 249 - DNA, 22 bp, Artificial Sequence
  mutagenesis primer
gttgcgcaagaaaccaatttcg

SEQ ID NO: 250 - DNA, 41 bp, Artificial Sequence
  mutagenesis primer
  misc_feature (20)..(21): n is a, c, g, or t
  misc_feature (22)..(22): k is G or T
cgaaattggtttcttgcgcnnkgcggagcttggcctgggcc

SEQ ID NO: 251 - DNA, 22 bp, Artificial Sequence
  mutagenesis primer
gccaagctccgcgttgcgcaag

SEQ ID NO: 252 - DNA, 39 bp, Artificial Sequence
  mutagenesis primer
  misc_feature (20)..(21): n is a, c, g, or t
  misc_feature (22)..(22): k is G or T
cttgcgcaacgcggagcttnnkctgggcctgctcattgg

SEQ ID NO: 253 - DNA, 2564 bp, Artificial Sequence
  fusion protein
atggacatagaggccaaatcgatcaacccgctcatgggcatcaccgtcggatctaccgtcctcgggaacgacttcaagccctccgtcctcatcaaccctatcactcgcatgatcacccagaaggagatcgagatgggcatgtccgggaagtcccagtacgtgtacacggattcgctcaacgagggtacgatcgggttctccggagcctatggaccgtcaggcatcgctaagttcacgagcgcggttgcagtgtcggtctccaatgccactgcctcggagtacaagtcgatcaaggtgtcctacaacatctcgatgatcagcgggatcgagtacatcgacttcgacaacctcacggtcgaggatgtgctgaacagcctctcagcaggtcccaagaacctctccctcaaagtgctggagaagttcatcgccgctagggactgctcgggttcgagtatcgagaaggacgagctgatgaaggagtgggtcaagtccctgcagaacttcatcagcagctacggtgacggactggtcgttggcgctatctggggaggcatgggaagcgtctcgacggagatgacgtcgaagaagacggaggactcgtggaagtacggcgaaacggctgagttctcctacagcggcatagggtcatccgtctcgatcgcccagacctacaacggctcgcagaaagaccagtcctccgaggtcgaagtcagctgcaaagcccttgcatcgggaggatgcgttgagtcccaggtcaactcatggttcgacgtggtcgccaacaagtcgttcgcggagatcagcggcatctcgctcctcgacaaagcgcctatgcagagcagcgtgtcaccgcctccgaagatcccggacttcctgaagcccgagaagaacgcggagatcacggagaagctggacacgatcaagaagctcggcgatagcgaggagttcgcactcgcatccggctacgaggaggcgaagaagaccaacccgaacctgaccttcgaggagttcaagtccacggtccgcgacaagaacaacatcgacggcctgaacgagctcgcgagcaaagtgcaggagaactctctggacgtgctggcggaaggctcgatctcgcgtcgcaacaagaacctcagcctccagggcgtcaggacgatctcgctcgacagcagcagcgactacgctgtcctcggagcgtggatcgccaactggagcgacatcttcccgtggatgagcatgggctacatgaacgagatcagcgacgccgaagtcgccgagtacatcctgaagatccggtgcatgatgcaagacctctccaccctcaacacgatctacaacacgttcaacgcctgcaacatcaagctggacttctgccacctcaactccgcatcccaagtcgcggacagcttcaagatcgcgcaaggtgtgctgtccgacaacgtcgagagcgacgatgccgtcgagatcgcgttcaactccctctccgacgaggcgaagaagatctacaccgcttggaacgagatcgggttcctcaggaacgcggagctcggacttggcctcctcattggcgaccagagcgtgagctccgagatcatcgacgtgaagcccataccgtatccggaggtcacctacaaggctgcctactgctcctacggcaacaacaacccgaccgcgttctcgagcttcatcaagatgctcccgttcatcgacacgaacggcgacatctacgccttcggaccatccctgatgctcctgaggaaggcacttccggagaagatgatcttcacgaagggcggtgagatggcgatgaagctcacggccgacaaggacacgggcatcctgacgaacgactcggtcaagctcatacccatcccgtactcggcagccaaaggcatccagtggagagggcaaggtcagggcagatcactggcatccagccagagtctccaggaccagtttgcagccctggagaaggagctgggcaacctgaacatctgcacgctgtcgagcgactcgtggagcaaggattggacctacacggttccctacacgctgcgcaagatctcgaccacctacatcggcaccgtcgagaagatcaacagcatcttcgggtgagaggagaagaagaacaccgccaaagacatcgcgacggaggagtcgaagatcagagcttatgcgcagtggatcgagatcaccatcttcgttgtcaactcgaacttcaaggtcgagggagcctacctgagatggggcaagttccacgttcccggtgacaaggacaaggagatctcgccgtcccagatcaacggcacgatcatcaaggacgaggactcctacaccatcgccagctgtgggagggagaacgcctcgtcaggcacagagggtggcttcagcctgtacgatggcgacaagctggtcttcgagtactactgggattgcccgtggagcggctcgaacagcgacgagctgaccgtgaaggacaaggagaactacacggtgatcaagaagggtggtggaagcccgtcaggagccaccggcaacatcttcatcacggtggtcaagaagtcctg

SEQ ID NO: 254 - protein, 853 aa, Artificial Sequence
  fusion protein
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFGEEKKNTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 255 - protein, 146 aa, Artificial Sequence
  AfIP-1A-31 variant
  VARIANT (6)..(6): Xaa at position 6 is Ile or Thr
  VARIANT (7)..(7): Xaa at position 7 is Ala or Val
  VARIANT (9)..(9): Xaa at position 9 is Glu or Gly
  VARIANT (13)..(13): Xaa at position 13 is Ile or Val
  VARIANT (19)..(19): Xaa at position 19 is Trp, Glu, Phe, Ile, His, Asn or Tyr
  VARIANT (20)..(20): Xaa at position 20 is Ile, Val, Ala, Cys, Glu, Phe, Gly, Met, Asn, Gln, Arg, Ser or Thr
  VARIANT (23)..(23): Xaa at position 23 is Thr or Ala
  VARIANT (24)..(24): Xaa at position 24 is Ile or Leu
  VARIANT (30)..(30): Xaa at position 30 is Asn or Ser
  VARIANT (33)..(33): Xaa at position 33 is Val or Ile
  VARIANT (35)..(35): Xaa at position 35 is Gly or Asn
  VARIANT (36)..(36): Xaa at position 36 is Ala, Gly, Asp, Glu, Phe, Gly, Ile, Leu, Pro, Gln, Arg, Ser, Thr, Val, Trp or Tyr
  VARIANT (37)..(37): Xaa at position 37 is Tyr, Ala, Cys, Asp, Glu, Gly, His, Ile, Lys, Leu, Met, Pro, Arg, Ser, Thr, Val or Trp
  VARIANT (38)..(38): Xaa at position 38 is Leu, Ala, Cys, Asp, Glu, Phe, Gly, His, Ile, Lys, Met, Gln, Arg, Ser, Thr, Val, Trp or Tyr
  VARIANT (39)..(39): Xaa at position 39 is Arg, Lys, Cys, Asp, Glu, Phe, Gly, Ile, Lys, Leu, Met, Asn, Pro, Ser, Thr, Val, Trp or Tyr
  VARIANT (40)..(40): Xaa at position 40 is Trp, Ala, Cys, Asp, Glu, Phe, Gly, His, Ile, Lys, Leu, Met, Asn, Pro, Gln, Arg, Ser, Thr, Val or Tyr
  VARIANT (41)..(41): Xaa at position 41 is Gly, Cys or Gln
  VARIANT (42)..(42): Xaa at position 42 is Lys, Cys, Glu, His, Leu, Met, Asn, Gln, Arg or Thr
  VARIANT (43)..(43): Xaa at position 43 is Phe, Tyr, Ala, Cys, Glu, Ile, Leu, Met, Gln, Ser, Val or Trp
  VARIANT (44)..(44): Xaa at position 44 is His, Ala, Asp, Glu, Gly, Lys, Leu, Met, Asn, Pro, Glu, Arg, Ser, Thr, Val, Trp
  VARIANT (45)..(45): Xaa at position 45 is Val, Ala, Cys, Asp, Glu, Phe, Gly, His, Ile, Lys, Leu, Asn, Pro, Gln, Arg, Ser, Thr or Trp
  VARIANT (46)..(46): Xaa at position 46 is Pro, Ala, Cys, Asp, Glu, Gly, His, Lys, Leu, Met, Gln, Arg, Ser, Thr, Val, Trp or Tyr
  VARIANT (47)..(47): Xaa at position 47 is Gly, Leu or Phe
  VARIANT (48)..(48): Xaa at position 48 is Asp, Asn, Leu or Phe
  VARIANT (49)..(49): Xaa at position 49 is Lys, Leu or Phe
  VARIANT (50)..(50): Xaa at position 50 is Asp, Leu or Phe
  VARIANT (51)..(51): Xaa at position 51 is Lys, Leu or Phe
  VARIANT (52)..(52): Xaa at position 52 is Glu, Leu or Phe
  VARIANT (53)..(53): Xaa at position 53 is Ile, Leu or Phe
  VARIANT (54)..(54): Xaa at position 54 is Ser, Thr, Leu or Phe
  VARIANT (55)..(55): Xaa at position 55 is Pro, Leu, or Phe
  VARIANT (56)..(56): Xaa at position 56 is Ser or Leu
  VARIANT (57)..(57): Xaa at position 57 is Gln, Glu, Leu or Phe
  VARIANT (58)..(58): Xaa at position 58 is Ile, Val, Leu or Phe
  VARIANT (60)..(60): Xaa at position 60 is Gly, Leu of Phe
  VARIANT (61)..(61): Xaa at position 61 is Thr, Ile or Phe
  VARIANT (62)..(62): Xaa at position 62 is Ile, Val, Leu or Phe
  VARIANT (64)..(64): Xaa at position 64 is Lys, Glu, Leu or Phe
  VARIANT (65)..(65): Xaa at position 65 is Asp, Leu or Phe
  VARIANT (67)..(67): Xaa at position 67 is Asp or Glu
  VARIANT (68)..(68): Xaa at position 68 is Ser or Thr
  VARIANT (73)..(73): Xaa at position 73 is Ser or Ala
  VARIANT (74)..(74): Xaa at position 74 is Cys, Ala, Asp, Glu, Gly, His, Ile, Lys, Leu, Asn, Pro, Gln, Arg, Ser, Thr or Tyr
  VARIANT (76)..(76): Xaa at position 76 is Arg, Cys, Asp, Glu, Phe, Gly, His, Ile, Lys, Leu, Met, Asn, Pro, Gln, Ser, Thr, Val, Trp or Tyr
  VARIANT (82)..(82): Xaa at position 82 is Gly, Glu, Asn, Trp or Tyr
  VARIANT (96)..(96): Xaa at position 96 is Val or Ile
  VARIANT (101)..(101): Xaa at position 101 is Trp, Phe or Tyr
  VARIANT (104)..(104): Xaa at position 104 is Pro, Ala, Phe, Gly, His, Met, Gln, Arg or Val
  VARIANT (105)..(105): Xaa at position 105 is Trp, Asp, Phe, Ile, Leu or Tyr
  VARIANT (111)..(111): Xaa at position 111 is Asp or Asn
  VARIANT (113)..(113): Xaa at position 113 is Leu or Ser
  VARIANT (115)..(115): Xaa at position 115 is Val or Ile
  VARIANT (116)..(116): Xaa at position 116 is Lys or Glu
  VARIANT (120)..(120): Xaa at position 120 is Asn or Lys
  VARIANT (121)..(121): Xaa at position 121 is Tyr, Leu or Phe
  VARIANT (122)..(122): Xaa at position 122 is Thr, Leu or Phe
  VARIANT (123)..(123): Xaa at position 123 is Val, Leu, Phe or Asn
  VARIANT (124)..(124): Xaa at position 124 is Ile, Ser, Leu or Phe
  VARIANT (125)..(125): Xaa at position 125 is Lys, Leu, Phe or Met
  VARIANT (126)..(126): Xaa at position 126 is Lys, Leu or Phe
  VARIANT (128)..(128): Xaa at position 128 is Gly, Leu or Phe
  VARIANT (129)..(129): Xaa at position 129 is Gly, Leu or Phe
  VARIANT (130)..(130): Xaa at position 130 is Ser, Leu or Phe
  VARIANT (132)..(132): Xaa at position 132 is Ser, Ala, Cys, Asp, Glu, Phe, Gly, His, Ile, Lys, Leu, Met, Asn, Pro, Gln, Arg, Thr, Val, Trp or Tyr
  VARIANT (133)..(133): Xaa at position 133 is Gly, Ala, Cys, Asp, Glu, Phe, His, Ile, Lys, Leu, Met, Asn, Pro, Gln, Arg, Ser, Thr, Val or Trp
  VARIANT (134)..(134): Xaa at position 134 is Ala, Cys, Asp, Glu, Phe, Gly, His, Ile, Lys, Leu, Met, Asn, Pro, Gln, Arg, Ser, Thr, Val, Trp or Tyr
  VARIANT (135)..(135): Xaa at position 135 is Thr, Ala, Cys, Asp, Glu, Phe, Gly, His, Ile, Lys, Leu, Met, Asn, Pro, Gln, Arg, Ser, Val, Trp or Tyr
  VARIANT (136)..(136): Xaa at position 136 is Gly, Ala, Cys, Asp, Glu, Phe, His, Ile, Lys, Leu, Met, Asn, Pro, Gln, Arg, Ser, Thr, Val, Trp or Tyr
  VARIANT (137)..(137): Xaa at position 137 is Asn, Ala, Cys, Asp, Glu, Phe, Gly, His, Ile, Lys, Leu, Met, Pro, Glu, Arg, Ser, Thr, Val, Trp or Tyr
  VARIANT (138)..(138): Xaa at position 138 is Ile, Ala, Cys, Asp, Glu, Phe, Gly, His, Lys, Leu, Met, Asn, Pro, Gln, Arg, Ser, Thr, Val, Trp or Tyr
  VARIANT (139)..(139): Xaa at position 139 is Phe, Ala, Cys, Asp, Glu, Gly, His, Ile, Lys, Leu, Met, Asn, Pro, Gln, Arg, Ser, Thr, Val, Trp or Tyr
  VARIANT (140)..(140): Xaa at position 140 is Ile, Ala, Cys, Phe, His, Leu, Met, Asn, Gln, Thr, Val or Tyr
MTAKDXXTXESKXRAYAQXXEIXXFVVNSXFKXEXXXXXXXXXXXXXXXXXXXXXXXXNXXXIXXEXXYTIAXXGXENASSXTEGGFSLYDGDKLXFEYYXDCXXSGSNSXEXTXXDKEXXXXXXXGXXXPXXXXXXXXXTVVKKS

SEQ ID NO: 256 - protein, 146 aa, Artificial Sequence
  AfIP-1A-31 variant
  VARIANT (6)..(6): Xaa at position 6 is Ile or Thr
  VARIANT (7)..(7): Xaa at position 7 is Ala, Met or Val
  VARIANT (8)..(8): Xaa at position 8 is Thr or Asp
  VARIANT (9)..(9): Xaa at position 9 is Glu, Leu or Gly
  VARIANT (10)..(10): Xaa at position 10 is Glu or Asn
  VARIANT (11)..(11): Xaa at position 11 is Ser or Val
  VARIANT (12)..(12): Xaa at position 12 is Lys or Glu
  VARIANT (13)..(13): Xaa at position 13 is Ile or Val
  VARIANT (14)..(14): Xaa at position 14 is Arg or Gln
  VARIANT (16)..(16): Xaa at position 16 is Tyr or Gln
  VARIANT (17)..(17): Xaa at position 17 is Ala or Ser
  VARIANT (19)..(19): Xaa at position 19 is Trp, Glu, Phe, Ile, His, Asn or Tyr
  VARIANT (20)..(20): Xaa at position 20 is Ile, Val, Ala, Cys, Glu, Phe, Gly, Met, Asn, Gln, Arg, Ser or Thr
  VARIANT (23)..(23): Xaa at position 23 is Thr, Glu or Ala
  VARIANT (24)..(24): Xaa at position 24 is Ile or Leu
  VARIANT (26)..(26): Xaa at position 26 is Val or Ser
  VARIANT (27)..(27): Xaa at position 27 is Val or Glu
  VARIANT (29)..(29): Xaa at position 29 is Ser or Met
  VARIANT (30)..(30): Xaa at position 30 is Asn, Asp or Ser
  VARIANT (31)..(31): Xaa at position 31 is Phe or Ile
  VARIANT (32)..(32): Xaa at position 32 is Lys or Glu
  VARIANT (33)..(33): Xaa at position 33 is Val or Ile
  VARIANT (34)..(34): Xaa at position 34 is Glu or Lys
  VARIANT (35)..(35): Xaa at position 35 is Gly or Asn
  VARIANT (36)..(36): Xaa at position 36 is Ala, Gly, Asp, Glu, Phe, Gly, Ile, Leu, Pro, Gln, Arg, Ser, Thr, Val, Trp or Tyr
  VARIANT (37)..(37): Xaa at position 37 is Tyr, Ala, Cys, Asp, Glu, Gly, His, Ile, Lys, Leu, Met, Pro, Arg, Ser, Thr, Val or Trp
  VARIANT (38)..(38): Xaa at position 38 is Leu, Ala, Cys, Asp, Glu, Phe, Gly, His, Ile, Lys, Met, Gln, Arg, Ser, Thr, Val, Trp or Tyr
  VARIANT (39)..(39): Xaa at position 39 is Arg, Lys, Cys, Asp, Glu, Phe, Gly, Ile, Lys, Leu, Met, Asn, Pro, Ser, Thr, Val, Trp or Tyr
  VARIANT (40)..(40): Xaa at position 40 is Trp, Ala, Cys, Asp, Glu, Phe, Gly, His, Ile, Lys, Leu, Met, Asn, Pro, Gln, Arg, Ser, Thr, Val or Tyr
  VARIANT (41)..(41): Xaa at position 41 is Gly, Cys or Gln
  VARIANT (42)..(42): Xaa at position 42 is Lys, Cys, Glu, His, Leu, Met, Asn, Gln, Arg or Thr
  VARIANT (43)..(43): Xaa at position 43 is Phe, Tyr, Ala, Cys, Glu, Ile, Leu, Met, Gln, Ser, Val or Trp
  VARIANT (44)..(44): Xaa at position 44 is His, Ala, Asp, Glu, Gly, Lys, Leu, Met, Asn, Pro, Glu, Arg, Ser, Thr, Val, Trp
  VARIANT (45)..(45): Xaa at position 45 is Val, Ala, Cys, Asp, Glu, Phe, Gly, His, Ile, Lys, Leu, Asn, Pro, Gln, Arg, Ser, Thr or Trp
  VARIANT (46)..(46): Xaa at position 46 is Pro, Ala, Cys, Asp, Glu, Gly, His, Lys, Leu, Met, Gln, Arg, Ser, Thr, Val, Trp or Tyr
  VARIANT (47)..(47): Xaa at position 47 is Gly, Leu or Phe
  VARIANT (48)..(48): Xaa at position 48 is Asp, Asn, Leu or Phe
  VARIANT (49)..(49): Xaa at position 49 is Lys, Leu or Phe
  VARIANT (50)..(50): Xaa at position 50 is Asp, Ser, Leu or Phe
  VARIANT (51)..(51): Xaa at position 51 is Lys, Asn, Leu or Phe
  VARIANT (52)..(52): Xaa at position 52 is Glu, Leu or Phe
  VARIANT (53)..(53): Xaa at position 53 is Ile, Leu or Phe
  VARIANT (54)..(54): Xaa at position 54 is Ser, Thr, Leu or Phe
  VARIANT (55)..(55): Xaa at position 55 is Pro, Ser, Leu, or Phe
  VARIANT (56)..(56): Xaa at position 56 is Ser, Asp, Leu
  VARIANT (57)..(57): Xaa at position 57 is Gln, Thr, Glu, Leu or Phe
  VARIANT (58)..(58): Xaa at position 58 is Ile, Val, Leu or Phe
  VARIANT (60)..(60): Xaa at position 60 is Gly, Lys, Leu or Phe
  VARIANT (61)..(61): Xaa at position 61 is Thr, Ile or Phe
  VARIANT (62)..(62): Xaa at position 62 is Ile, Lys, Val, Leu or Phe
  VARIANT (64)..(64): Xaa at position 64 is Lys, Ser, Glu, Leu or Phe
  VARIANT (65)..(65): Xaa at position 65 is Asp, Ser, Leu or Phe
  VARIANT (66)..(66): Xaa at position 66 is Glu or Gly
  VARIANT (67)..(67): Xaa at position 67 is Asp, Thr or Glu
  VARIANT (68)..(68): Xaa at position 68 is Ser, Lys or Thr
  VARIANT (69)..(69): Xaa at position 69 is Tyr or Ser
  VARIANT (70)..(70): Xaa at position 70 is Thr or Lys
  VARIANT (73)..(73): Xaa at position 73 is Ser or Ala
  VARIANT (74)..(74): Xaa at position 74 is Cys, Ala, Asp, Glu, Gly, His, Ile, Lys, Leu, Asn, Pro, Gln, Arg, Ser, Thr or Tyr
  VARIANT (76)..(76): Xaa at position 76 is Arg, Cys, Asp, Glu, Phe, Gly, His, Ile, Lys, Leu, Met, Asn, Pro, Gln, Ser, Thr, Val, Trp or Tyr
  VARIANT (77)..(77): Xaa at position 77 is Glu or Ala
  VARIANT (78)..(78): Xaa at position 78 is Asn or Asp
  VARIANT (79)..(79): Xaa at position 79 is Ala or Thr
  VARIANT (82)..(82): Xaa at position 82 is Gly, Glu, Asn, Trp or Tyr
  VARIANT (86)..(86): Xaa at position 86 is Gly or Lys
  VARIANT (88)..(88): Xaa at position 88 is Ser or Glu
  VARIANT (89)..(89): Xaa at position 89 is Leu or Ile
  VARIANT (91)..(91): Xaa at position 91 is Asp or His
  VARIANT (92)..(92): Xaa at position 92 is Gly or Asp
  VARIANT (95)..(95): Xaa at position 95 is Leu or Trp
  VARIANT (96)..(96): Xaa at position 96 is Val, Leu or Ile
  VARIANT (97)..(97): Xaa at position 97 is Phe or Ala
  VARIANT (98)..(98): Xaa at position 98 is Glu or Thr
  VARIANT (100)..(100): Xaa at position 100 is Tyr or Lys
  VARIANT (101)..(101): Xaa at position 101 is Trp, Phe or Tyr
  VARIANT (104)..(104): Xaa at position 104 is Pro, Ala, Phe, Gly, His, Met, Gln, Arg or Val
  VARIANT (105)..(105): Xaa at position 105 is Trp, Asp, Phe, Ile, Leu or Tyr
  VARIANT (106)..(106): Xaa at position 106 is Ser or Ala
  VARIANT (111)..(111): Xaa at position 111 is Asp, His or Asn
  VARIANT (112)..(112): Xaa at position 112 is Glu or Ser
  VARIANT (113)..(113): Xaa at position 113 is Leu or Ser
  VARIANT (114)..(114): Xaa at position 114 is Thr or Ser
  VARIANT (115)..(115): Xaa at position 115 is Val or Ile
  VARIANT (116)..(116): Xaa at position 116 is Lys, Thr or Glu
  VARIANT (117)..(117): Xaa at position 117 is Asp or Glu
  VARIANT (118)..(118): Xaa at position 118 is Lys or Asp
  VARIANT (119)..(119): Xaa at position 119 is Glu or Asn
  VARIANT (120)..(120): Xaa at position 120 is Asn or Lys
  VARIANT (121)..(121): Xaa at position 121 is Tyr, Leu or Phe
  VARIANT (122)..(122): Xaa at position 122 is Thr or Lys
  VARIANT (123)..(123): Xaa at position 123 is Val, Ile, Leu, Phe or Asn
  VARIANT (124)..(124): Xaa at position 124 is Ile, Ser, Asp, Leu or Phe
  VARIANT (125)..(125): Xaa at position 125 is Lys, Leu, Phe or Met
  VARIANT (126)..(126): Xaa at position 126 is Lys, Glu, Leu or Phe
  VARIANT (128)..(128): Xaa at position 128 is Gly, Leu or Phe
  VARIANT (129)..(129): Xaa at position 129 is Gly, Asn, Leu or Phe
  VARIANT (130)..(130): Xaa at position 130 is Ser, Ile, Leu or Phe
  VARIANT (131)..(131): Xaa at position 131 is Pro or Ser
  VARIANT (132)..(132): Xaa at position 132 is Ser, Ala, Cys, Asp, Glu, Phe, Gly, His, Ile, Lys, Leu, Met, Asn, Pro, Gln, Arg, Thr, Val, Trp or Tyr
  VARIANT (133)..(133): Xaa at position 133 is Gly, Ala, Cys, Asp, Glu, Phe, His, Ile, Lys, Leu, Met, Asn, Pro, Gln, Arg, Ser, Thr, Val or Trp
  VARIANT (134)..(134): Xaa at position 134 is Ala, Cys, Asp, Glu, Phe, Gly, His, Ile, Lys, Leu, Met, Asn, Pro, Gln, Arg, Ser, Thr, Val, Trp or Tyr
  VARIANT (135)..(135): Xaa at position 135 is Thr, Ala, Cys, Asp, Glu, Phe, Gly, His, Ile, Lys, Leu, Met, Asn, Pro, Gln, Arg, Ser, Val, Trp or Tyr
  VARIANT (136)..(136): Xaa at position 136 is Gly, Ala, Cys, Asp, Glu, Phe, His, Ile, Lys, Leu, Met, Asn, Pro, Gln, Arg, Ser, Thr, Val, Trp or Tyr
  VARIANT (137)..(137): Xaa at position 137 is Asn, Ala, Cys, Asp, Glu, Phe, Gly, His, Ile, Lys, Leu, Met, Pro, Glu, Arg, Ser, Thr, Val, Trp or Tyr
  VARIANT (138)..(138): Xaa at position 138 is Ile, Ala, Cys, Asp, Glu, Phe, Gly, His, Lys, Leu, Met, Asn, Pro, Gln, Arg, Ser, Thr, Val, Trp or Tyr
  VARIANT (139)..(139): Xaa at position 139 is Phe, Ala, Cys, Asp, Glu, Gly, His, Ile, Lys, Leu, Met, Asn, Pro, Gln, Arg, Ser, Thr, Val, Trp or Tyr
  VARIANT (140)..(140): Xaa at position 140 is Ile, Ala, Cys, Phe, His, Leu, Met, Asn, Gln, Thr, Val or Tyr
  VARIANT (142)..(142): Xaa at position 142 is Val or Cys
  VARIANT (143)..(143): Xaa at position 143 is Val or Ile
  VARIANT (145)..(145): Xaa at position 145 is Lys or Val
  VARIANT (146)..(146): Xaa at position 146 is Ser or Gly
MTAKDXXXXXXXXXAXXQXXEIXXFXXNXXXXXXXXXXXXXXXXXXXXXXXXXXXXXXNXXXIXXXXXXXIAXXGXXXXSSXTEGXFXXYXXDKXXXXYXXDCXXXGSNSXXXTXXXXXXXXXXXXGXXXXXXXXXXXXXTXXKXX

SEQ ID NO: 257 - protein, 146 aa, Artificial Sequence
  AfIP-1A-31 variant
  VARIANT (6)..(6): Xaa at position 6 is Ile, Thr, Leu, Met, Val or Ser
  VARIANT (7)..(7): Xaa at position 7 is Ala, Met, Val, Leu, Ile or Gly
  VARIANT (8)..(8): Xaa at position 8 is Thr, Asp, Ser or Glu
  VARIANT (9)..(9): Xaa at position 9 is Glu, Leu, Gly, Asp, Ala, Ile, Val or Met
  VARIANT (10)..(10): Xaa at position 10 is Glu, Asn, Asp or Gln
  VARIANT (11)..(11): Xaa at position 11 is Ser, Val, Thr, Ile, Leu or Met
  VARIANT (12)..(12): Xaa at position 12 is Lys, Glu, Arg or Asp
  VARIANT (13)..(13): Xaa at position 13 is Ile, Val, Leu or Met
  VARIANT (14)..(14): Xaa at position 14 is Arg, Gln, Lys or Asn
  VARIANT (16)..(16): Xaa at position 16 is Tyr, Gln, Trp, Phe or Asn
  VARIANT (17)..(17): Xaa at position 17 is Ala, Ser, Gly or Thr
  VARIANT (19)..(19): Xaa at position 19 is Trp, Glu, Phe, Ile, His, Asn or Tyr
  VARIANT (20)..(20): Xaa at position 20 is Ile, Val, Ala, Cys, Glu, Phe, Gly, Met, Asn, Gln, Arg, Ser or Thr
  VARIANT (23)..(23): Xaa at position 23 is Thr, Glu, Ala, Ser, Asp or Gly
  VARIANT (24)..(24): Xaa at position 24 is Ile, Leu, Val or Met
  VARIANT (26)..(26): Xaa at position 26 is Val, Ser, Ile, Leu, Met or Thr
  VARIANT (27)..(27): Xaa at position 27 is Val, Glu, Ile, Leu, Met or Asp
  VARIANT (29)..(29): Xaa at position 29 is Ser, Met, Thr, Ile, Leu or Val
  VARIANT (30)..(30): Xaa at position 30 is Asn, Asp, Ser, Glu, Gln or Thr
  VARIANT (31)..(31): Xaa at position 31 is Phe, Ile, Leu, Val or Met
  VARIANT (32)..(32): Xaa at position 32 is Lys, Glu, Arg or Asp
  VARIANT (33)..(33): Xaa at position 33 is Val, Ile, Leu or Met
  VARIANT (34)..(34): Xaa at position 34 is Glu, Lys, Asp or Arg
  VARIANT (35)..(35): Xaa at position 35 is Gly or Asn
  VARIANT (36)..(36): Xaa at position 36 is Ala, Gly, Asp, Glu, Phe, Gly, Ile, Leu, Pro, Gln, Arg, Ser, Thr, Val, Trp or Tyr
  VARIANT (37)..(37): Xaa at position 37 is Tyr, Ala, Cys, Asp, Glu, Gly, His, Ile, Lys, Leu, Met, Pro, Arg, Ser, Thr, Val or Trp
  VARIANT (38)..(38): Xaa at position 38 is Leu, Ala, Cys, Asp, Glu, Phe, Gly, His, Ile, Lys, Met, Gln, Arg, Ser, Thr, Val, Trp or Tyr
  VARIANT (39)..(39): Xaa at position 39 is Arg, Lys, Cys, Asp, Glu, Phe, Gly, Ile, Lys, Leu, Met, Asn, Pro, Ser, Thr, Val, Trp or Tyr
  VARIANT (40)..(40): Xaa at position 40 is Trp, Ala, Cys, Asp, Glu, Phe, Gly, His, Ile, Lys, Leu, Met, Asn, Pro, Gln, Arg, Ser, Thr, Val or Tyr
  VARIANT (41)..(41): Xaa at position 41 is Gly, Cys or Gln
  VARIANT (42)..(42): Xaa at position 42 is Lys, Cys, Glu, His, Leu, Met, Asn, Gln, Arg or Thr
  VARIANT (43)..(43): Xaa at position 43 is Phe, Tyr, Ala, Cys, Glu, Ile, Leu, Met, Gln, Ser, Val or Trp
  VARIANT (44)..(44): Xaa at position 44 is His, Ala, Asp, Glu, Gly, Lys, Leu, Met, Asn, Pro, Glu, Arg, Ser, Thr, Val, Trp
  VARIANT (45)..(45): Xaa at position 45 is Val, Ala, Cys, Asp, Glu, Phe, Gly, His, Ile, Lys, Leu, Asn, Pro, Gln, Arg, Ser, Thr or Trp
  VARIANT (46)..(46): Xaa at position 46 is Pro, Ala, Cys, Asp, Glu, Gly, His, Lys, Leu, Met, Gln, Arg, Ser, Thr, Val, Trp or Tyr
  VARIANT (47)..(47): Xaa at position 47 is Gly, Leu or Phe
  VARIANT (48)..(48): Xaa at position 48 is Asp, Asn, Glu, Gln, Leu or Phe
  VARIANT (50)..(50): Xaa at position 50 is Asp, Ser, Glu, Thr, Leu or Phe
  VARIANT (51)..(51): Xaa at position 51 is Lys, Asn, Arg, Gln, Leu or Phe
  VARIANT (52)..(52): Xaa at position 52 is Glu, Leu or Phe
  VARIANT (53)..(53): Xaa at position 53 is Ile, Leu or Phe
  VARIANT (54)..(54): Xaa at position 54 is Ser, Thr, Leu or Phe
  VARIANT (55)..(55): Xaa at position 55 is Pro, Ser, Thr, Leu or Phe
  VARIANT (56)..(56): Xaa at position 56 is Ser, Asp, Thr, Glu, or Leu
  VARIANT (57)..(57): Xaa at position 57 is Gln, Thr, Glu, Asn, Ser, Asp, Leu or Phe
  VARIANT (58)..(58): Xaa at position 58 is Ile, Val, Leu, Met or Phe
  VARIANT (60)..(60): Xaa at position 60 is Gly, Lys, Ala or Arg
  VARIANT (61)..(61): Xaa at position 61 is Thr, Ile or Phe
  VARIANT (62)..(62): Xaa at position 62 is Ile, Lys, Val, Leu, Met, Arg or Phe
  VARIANT (64)..(64): Xaa at position 64 is Lys, Ser, Glu, Arg, Thr, Asp, Leu or Phe
  VARIANT (65)..(65): Xaa at position 65 is Asp, Ser, Glu, Thr, Leu or Phe
  VARIANT (66)..(66): Xaa at position 66 is Glu, Gly, Asp or Ala
  VARIANT (67)..(67): Xaa at position 67 is Asp, Thr, Glu or Ser
  VARIANT (68)..(68): Xaa at position 68 is Ser, Lys, Thr or Arg
  VARIANT (69)..(69): Xaa at position 69 is Tyr, Ser, Trp, Phe or Thr
  VARIANT (70)..(70): Xaa at position 70 is Thr, Lys, Ser or Arg
  VARIANT (73)..(73): Xaa at position 73 is Ser, Ala, Thr or Gly
  VARIANT (74)..(74): Xaa at position 74 is Cys, Ala, Asp, Glu, Gly, His, Ile, Lys, Leu, Asn, Pro, Gln, Arg, Ser, Thr or Tyr
  VARIANT (76)..(76): Xaa at position 76 is Arg, Cys, Asp, Glu, Phe, Gly, His, Ile, Lys, Leu, Met, Asn, Pro, Gln, Ser, Thr, Val, Trp or Tyr
  VARIANT (77)..(77): Xaa at position 77 is Glu, Ala, Asp or Gly
  VARIANT (78)..(78): Xaa at position 78 is Asn, Asp, Gln or Glu
  VARIANT (79)..(79): Xaa at position 79 is Ala, Thr, Gly or Ser
  VARIANT (82)..(82): Xaa at position 82 is Gly, Glu, Asn, Trp or Tyr
  VARIANT (86)..(86): Xaa at position 86 is Gly, Lys, Ala or Arg
  VARIANT (88)..(88): Xaa at position 88 is Ser, Glu, Thr or Asp
  VARIANT (89)..(89): Xaa at position 89 is Leu, Ile, Val or Met
  VARIANT (91)..(91): Xaa at position 91 is Asp, His or Glu
  VARIANT (92)..(92): Xaa at position 92 is Gly, Asp, Ala or Glu
  VARIANT (95)..(95): Xaa at position 95 is Leu, Trp, Ile, Val, Met, Phe or Tyr
  VARIANT (96)..(96): Xaa at position 96 is Val, Leu, Ile or Met
  VARIANT (97)..(97): Xaa at position 97 is Phe, Ala or Gly
  VARIANT (98)..(98): Xaa at position 98 is Glu, Thr, Asp or Ser
  VARIANT (100)..(100): Xaa at position 100 is Tyr, Lys, Trp or Arg
  VARIANT (101)..(101): Xaa at position 101 is Trp, Phe or Tyr
  VARIANT (104)..(104): Xaa at position 104 is Pro, Ala, Phe, Gly, His, Met, Gln, Arg or Val
  VARIANT (105)..(105): Xaa at position 105 is Trp, Asp, Phe, Ile, Leu or Tyr
  VARIANT (106)..(106): Xaa at position 106 is Ser, Ala, Thr or Gly
  VARIANT (111)..(111): Xaa at position 111 is Asp, His, Asn, Glu or Gln
  VARIANT (112)..(112): Xaa at position 112 is Glu, Ser, Asp or Thr
  VARIANT (113)..(113): Xaa at position 113 is Leu, Ser, Ile, Val, Met or Thr
  VARIANT (114)..(114): Xaa at position 114 is Thr or Ser
  VARIANT (115)..(115): Xaa at position 115 is Val, Ile, Val or Met
  VARIANT (116)..(116): Xaa at position 116 is Lys, Thr, Glu, Arg, Ser or Asp
  VARIANT (117)..(117): Xaa at position 117 is Asp or Glu
  VARIANT (118)..(118): Xaa at position 118 is Lys, Asp, Arg or Glu
  VARIANT (119)..(119): Xaa at position 119 is Glu, Asn, Asp or Gln
  VARIANT (120)..(120): Xaa at position 120 is Asn, Lys, Asp or Arg
  VARIANT (121)..(121): Xaa at position 121 is Tyr, Leu or Phe
  VARIANT (122)..(122): Xaa at position 122 is Thr, Lys, Ser, Arg, Leu or Phe
  VARIANT (123)..(123): Xaa at position 123 is Val, Ile, Leu, Met, Phe or Asn
  VARIANT (124)..(124): Xaa at position 124 is Ile, Ser, Asp, Leu, Val Met, Thr, Glu or Phe
  VARIANT (125)..(125): Xaa at position 125 is Lys, Leu, Phe or Met
  VARIANT (126)..(126): Xaa at position 126 is Lys, Glu, Arg or Asp
  VARIANT (128)..(128): Xaa at position 128 is Gly, Leu or Phe
  VARIANT (129)..(129): Xaa at position 129 is Gly, Asn, Ala, Gln, Leu or Phe
  VARIANT (130)..(130): Xaa at position 130 is Ser, Ile, Thr, Leu, Val, Met or Phe
  VARIANT (131)..(131): Xaa at position 131 is Pro, Ser or Thr
  VARIANT (132)..(132): Xaa at position 132 is Ser, Ala, Cys, Asp, Glu, Phe, Gly, His, Ile, Lys, Leu, Met, Asn, Pro, Gln, Arg, Thr, Val, Trp or Tyr
  VARIANT (133)..(133): Xaa at position 133 is Gly, Ala, Cys, Asp, Glu, Phe, His, Ile, Lys, Leu, Met, Asn, Pro, Gln, Arg, Ser, Thr, Val or Trp
  VARIANT (134)..(134): Xaa at position 134 is Ala, Cys, Asp, Glu, Phe, Gly, His, Ile, Lys, Leu, Met, Asn, Pro, Gln, Arg, Ser, Thr, Val, Trp or Tyr
  VARIANT (135)..(135): Xaa at position 135 is Thr, Ala, Cys, Asp, Glu, Phe, Gly, His, Ile, Lys, Leu, Met, Asn, Pro, Gln, Arg, Ser, Val, Trp or Tyr
  VARIANT (136)..(136): Xaa at position 136 is Gly, Ala, Cys, Asp, Glu, Phe, His, Ile, Lys, Leu, Met, Asn, Pro, Gln, Arg, Ser, Thr, Val, Trp or Tyr
  VARIANT (137)..(137): Xaa at position 137 is Asn, Ala, Cys, Asp, Glu, Phe, Gly, His, Ile, Lys, Leu, Met, Pro, Glu, Arg, Ser, Thr, Val, Trp or Tyr
  VARIANT (138)..(138): Xaa at position 138 is Ile, Ala, Cys, Asp, Glu, Phe, Gly, His, Lys, Leu, Met, Asn, Pro, Gln, Arg, Ser, Thr, Val, Trp or Tyr
  VARIANT (139)..(139): Xaa at position 139 is Phe, Ala, Cys, Asp, Glu, Gly, His, Ile, Lys, Leu, Met, Asn, Pro, Gln, Arg, Ser, Thr, Val, Trp or Tyr
  VARIANT (140)..(140): Xaa at position 140 is Ile, Ala, Cys, Phe, His, Leu, Met, Asn, Gln, Thr, Val or Tyr
  VARIANT (142)..(142): Xaa at position 142 is Val, Cys, Ile, Leu or Met
  VARIANT (143)..(143): Xaa at position 143 is Val, Ile; Leu or Met
  VARIANT (145)..(145): Xaa at position 145 is Lys, Val, Arg, Ile, Leu or Met
  VARIANT (146)..(146): Xaa at position 146 is Ser, Gly, Thr or Ala
MTAKDXXXXXXXXXAXXQXXEIXXFXXNXXXXXXXXXXXXXXXXXXXXKXXXXXXXXXNXXXIXXXXXXXIAXXGXXXXSSXTEGXFXXYXXDKXXXXYXXDCXXXGSNSXXXXXXXXXXXXXXXXGXXXXXXXXXXXXXTXXKXX

SEQ ID NO: 258 - protein, 703 aa, Artificial Sequence
  AfIP-1B-32 variant
  VARIANT (12)..(12): Xaa at position 12 is Met or Leu
  VARIANT (34)..(34): Xaa at position 34 is Ile or Leu
  VARIANT (38)..(38): Xaa at position 38 is Ile or Leu
  VARIANT (42)..(42): Xaa at position 42 is Glu or Asp
  VARIANT (43)..(43): Xaa at position 43 is Ile or Leu
  VARIANT (53)..(53): Xaa at position 53 is Tyr or Phe
  VARIANT (55)..(55): Xaa at position 55 is Tyr or Phe
  VARIANT (71)..(71): Xaa at position 71 is Gly or Cys
  VARIANT (86)..(86): Xaa at position 86 is Val or Leu
  VARIANT (94)..(94): Xaa at position 94 is Tyr or Phe
  VARIANT (97)..(97): Xaa at position 97 is Ile or Leu
  VARIANT (101)..(101): Xaa at position 101 is Tyr or Phe
  VARIANT (103)..(103): Xaa at position 103 is Ile, Leu, Gly, Val, Trp, Phe, Thr, Cys, Glu or Arg
  VARIANT (105)..(105): Xaa at position 105 is Met, Gly, Val, Leu, Trp, Phe, Pro, Thr, Cys, Asn, Gln or Arg
  VARIANT (106)..(106): Xaa at position 106 is Ile or Leu
  VARIANT (108)..(108): Xaa at position 108 is Gly, Ala, Leu, Val, Ile, Met, Trp, Phe, Ser, Thr, Cys, Tyr, Asn, Gln, Asp, Lys or His
  VARIANT (109)..(109): Xaa at position 109 is Ile, Leu, Ala, Val, Leu, Met, Trp, Phe, Pro, Cys, Asn or Glu
  VARIANT (110)..(110): Xaa at position 110 is Glu, Gly, Ala, Val, Leu, Met, Trp, Ser, Thr, Cys, Tyr, Asp, Arg, or His
  VARIANT (111)..(111): Xaa at position 111 is Tyr, Gly, Ala, Val, Leu, Ile, Met, Trp, Ser, Thr, Cys, Asp, Glu, Lys , Arg or His
  VARIANT (115)..(115): Xaa at position 115 is Asp or Glu
  VARIANT (119)..(119): Xaa at position 119 is Val or Ala
  VARIANT (134)..(134): Xaa at position 134 is Ser or Leu
  VARIANT (137)..(137): Xaa at position 137 is Val, Phe, Ala, Leu, Trp, Pro, Ser, Cys Asp, Glu or Arg
  VARIANT (139)..(139): Xaa at position 139 is Glu or Asp
  VARIANT (141)..(141): Xaa at position 141 is Phe, Val, Leu, Ile, Trp, Ser or Cys
  VARIANT (144)..(144): Xaa at position 144 is Ala or Val
  VARIANT (148)..(148): Xaa at position 148 is Ser, Phe or Thr
  VARIANT (152)..(152): Xaa at position 152 is Ile or Thr
  VARIANT (155)..(155): Xaa at position 155 is Asp or Glu
  VARIANT (179)..(179): Xaa at position 179 is Gly, Val, Trp, Ser, Cys or Arg
  VARIANT (181)..(181): Xaa at position 181 is Ile, Val or Leu
  VARIANT (182)..(182): Xaa at position 182 is Trp, Gly, Ala, Val, Leu, Met, Ser, Cys, Glu or Arg
  VARIANT (188)..(188): Xaa at position 188 is Val or Leu
  VARIANT (196)..(196): Xaa at position 196 is Lys or Glu
  VARIANT (197)..(197): Xaa at position 197 is Thr or Ser
  VARIANT (201)..(201): Xaa at position 201 is Trp, Cys, or Phe
  VARIANT (202)..(202): Xaa at position 202 is Lys or Asn
  VARIANT (203)..(203): Xaa at position 203 is Tyr or Phe
  VARIANT (208)..(208): Xaa at position 208 is Glu or Asp
  VARIANT (214)..(214): Xaa at position 214 is Ile or Leu
  VARIANT (220)..(220): Xaa at position 220 is Ile or Leu
  VARIANT (224)..(224): Xaa at position 224 is Tyr or Phe
  VARIANT (234)..(234): Xaa at position 234 is Glu or Asp
  VARIANT (235)..(235): Xaa at position 235 is Val or Leu
  VARIANT (270)..(270): Xaa at position 270 is Ile or Val
  VARIANT (296)..(296): Xaa at position 296 is Lys or Glu
  VARIANT (298)..(298): Xaa at position 298 is Ala or Glu
  VARIANT (299)..(299): Xaa at position 299 is Glu or Gly
  VARIANT (300)..(300): Xaa at position 300 is Ile or Val
  VARIANT (305)..(305): Xaa at position 305 is Asp or Glu
  VARIANT (317)..(317): Xaa at position 317 is Ala or Ser
  VARIANT (323)..(323): Xaa at position 323 is Glu or Asp
  VARIANT (335)..(335): Xaa at position 335 is Glu or Asp
  VARIANT (352)..(352): Xaa at position 352 is Glu or Asp
  VARIANT (359)..(359): Xaa at position 359 is Glu, Gly, Ala, Val, Leu, Trp, Phe, Pro, Ser, Thr, Lys or Arg
  VARIANT (360)..(360): Xaa at position 360 is Asn, Gly, Val, Leu, Ile, Met, Phe, Pro, Thr, Asn, Asp, Lys, Arg or His
  VARIANT (361)..(361): Xaa at position 361 is Ser, Gly, Val, Leu or Glu
  VARIANT (363)..(363): Xaa at position 363 is Asp, Gly, Leu, Ile, Trp or Ser
  VARIANT (364)..(364): Xaa at position 364 is Val, Pro, Ser, Thr, Asn, Gln, Asp, Glu or Lys
  VARIANT (365)..(365): Xaa at position 365 is Leu, Gly, Ala, Val, Ile, Trp, Phe, Pro, Ser, Thr, Cys, Tyr, Gln, Asp, Glu, Arg or His
  VARIANT (367)..(367): Xaa at position 367 is Glu or Lys
  VARIANT (368)..(368): Xaa at position 368 is Gly or Asp
  VARIANT (370)..(370): Xaa at position 370 is Ile or Val
  VARIANT (373)..(373): Xaa at position 373 is Arg or Ser
  VARIANT (374)..(374): Xaa at position 374 is Asn or Lys
  VARIANT (377)..(377): Xaa at position 377 is Leu or Ile
  VARIANT (384)..(384): Xaa at position 384 is Thr or Ala
  VARIANT (385)..(385): Xaa at position 385 is Ile or Ser
  VARIANT (388)..(388): Xaa at position 388 is Asp or Glu
  VARIANT (393)..(393): Xaa at position 393 is Tyr or Phe
  VARIANT (398)..(398): Xaa at position 398 is Ala or Val
  VARIANT (414)..(414): Xaa at position 414 is Tyr or Phe
  VARIANT (418)..(418): Xaa at position 418 is Ile or Leu
  VARIANT (419)..(419): Xaa at position 419 is Ser or Asn
  VARIANT (423)..(423): Xaa at position 423 is Val or Leu
  VARIANT (425)..(425): Xaa at position 425 is Glu or Val
  VARIANT (427)..(427): Xaa at position 427 is Ile or Val
  VARIANT (434)..(434): Xaa at position 434 is Met or Thr
  VARIANT (481)..(481): Xaa at position 481 is Glu or Asp
  VARIANT (495)..(495): Xaa at position 495 is Asp or Glu
  VARIANT (509)..(509): Xaa at position 509 is Phe, Gly, Ala, Val, Leu, Ile, Met, Trp, Ser, Cys, Tyr, Asn, Asp, Glu or Arg
  VARIANT (512)..(512): Xaa at position 512 is Asn, Ser, Gly, Ala, Leu, Met, Trp, Phe, Ser, Thr, Cys, Gln or Arg
  VARIANT (514)..(514): Xaa at position 514 is Glu, Gly, Ile, Asp or Arg
  VARIANT (516)..(516): Xaa at posioitn 516 is Gly, Ala, Val, Met, Pro, Thr, Asn, Gln, Asp, Glu or Lys
  VARIANT (519)..(519): Xaa at position 519 is Leu, Gly, Ala, Val, Met, Phe, Pro, Tyr, Gln, Asp, Lys or Arg
  VARIANT (526)..(526): Xaa at position 526 is Val or Leu
  VARIANT (530)..(530): Xaa at position 530 is Ile or Leu
  VARIANT (533)..(533): Xaa at position 533 is Val or Ala
  VARIANT (536)..(536): Xaa at position 536 is Ile or Leu
  VARIANT (538)..(538): Xaa at position 538 is Tyr or Phe
  VARIANT (543)..(543): Xaa at position 543 is Tyr or Phe
  VARIANT (544)..(544): Xaa at position 544 is Lys or Arg
  VARIANT (547)..(547): Xaa at position 547 is Tyr or Phe
  VARIANT (550)..(550): Xaa at position 550 is Tyr or Phe
  VARIANT (552)..(552): Xaa at position 552 is Asn or Ser
  VARIANT (558)..(558): Xaa at position 558 is Phe or Leu
  VARIANT (600)..(600): Xaa at position 600 is Met or Val
  VARIANT (602)..(602): Xaa at position 602 is Met or Ile
  VARIANT (607)..(607): Xaa at position 607 is Asp or Gly
  VARIANT (610)..(610): Xaa at position 610 is Thr or Lys
  VARIANT (612)..(612): Xaa at position 612 is Ile or Thr
  VARIANT (613)..(613): Xaa at position 613 is Leu or Pro
  VARIANT (615)..(615): Xaa at position 615 is Asn or Asp
  VARIANT (619)..(619): Xaa at position 619 is Lys or Arg
  VARIANT (625)..(625): Xaa at position 625 is Tyr or Phe
  VARIANT (631)..(631): Xaa at position 631 is Ile, Val, or Leu
  VARIANT (633)..(633): Xaa at position 633 is Trp or Phe
  VARIANT (646)..(646): Xaa at position 646 is Gln or Arg
  VARIANT (661)..(661): Xaa at position 661 is Asn or Ser
  VARIANT (683)..(683): Xaa at position 683 is Thr or Ala
  VARIANT (696)..(696): Xaa at position 696 is Glu or Asp
  VARIANT (700)..(700): Xaa at position 700 is Ser or Gly
  VARIANT (702)..(702): Xaa at position 702 is Phe or Ser
MDIEAKSINPLXGITVGSTVLGNDFKPSVLINPXTRMXTQKXXEMGMSGKSQXVXTDSLNEGTIGFSGAYXPSGIAKFTSAVAVSXSNATASEXKSXKVSXNXSXXSXXXXIDFXNLTXEDVLNSLSAGPKNLXLKXLXKXIAXRDCXGSSXEKXELMKEWVKSLQNFISSYGDGLVVXAXXGGMGSXSTEMTSKXXEDSXXXGETAXFSYSGXGSSVSXAQTXNGSQKDQSSXXEVSCKALASGGCVESQVNSWFDVVANKSFAEISGXSLLDKAPMQSSVSPPPKIPDFLKPEXNXXXTEKLXTIKKLGDSEEFXLASGYXEAKKTNPNLTFXEFKSTVRDKNNIDGLNXLASKVQXXXLXXXAXXSXSRXXKNXSLQGVRXXSLXSSSDXAVLGXWIANWSDIFPWMSMGXMNEXXDAEXAXYXLKIRCMXQDLSTLNTIYNTFNACNIKLDFCHLNSASQVADSFKIAQGVLSDNVXSDDAVEIAFNSLSXEAKKIYTAWNEIGXLRXAXLXLGXLIGDQSXSSEXIDXKPXPXPEVTXXAAXCSXGXNNPTAXSSFIKMLPFIDTNGDIYAFGPSLMLLRKALPEKMIFTKGGEXAXKLTAXKDXGXXTXDSVXLIPIPXSAAKGXQXRGQGQGRSLASSXSLQDQFAALEKELGXLNICTLSSDSWSKDWTYTVPYXLRKISTTYIGTVXKINXIXG

SEQ ID NO: 259 - protein, 703 aa, Artificial Sequence; identical to SEQ ID NO: 258
  AfIP-1B-32 variant
  VARIANT (12)..(12): Xaa at position 12 is Met, Leu, Ile or Val
  VARIANT (34)..(34): Xaa at position 34 is Ile or Leu
  VARIANT (38)..(38): Xaa at position 38 is Ile or Leu
  VARIANT (42)..(42): Xaa at position 42 is Glu or Asp
  VARIANT (43)..(43): Xaa at position 43 is Ile or Leu
  VARIANT (53)..(53): Xaa at position 53 is Tyr or Phe
  VARIANT (55)..(55): Xaa at position 55 is Tyr or Phe
  VARIANT (71)..(71): Xaa at position 71 is Gly, Cys or Ala
  VARIANT (86)..(86): Xaa at position 86 is Val or Leu
  VARIANT (94)..(94): Xaa at position 94 is Tyr or Phe
  VARIANT (97)..(97): Xaa at position 97 is Ile or Leu
  VARIANT (101)..(101): Xaa at position 101 is Tyr or Phe
  VARIANT (103)..(103): Xaa at position 103 is Ile, Leu, Gly, Val, Trp, Phe, Thr, Cys, Glu or Arg
  VARIANT (105)..(105): Xaa at position 105 is Met, Gly, Val Leu, Trp, Phe, Pro, Thr, Cys, Asn, Gln or Arg
  VARIANT (106)..(106): Xaa at position 106 is Ile or Leu
  VARIANT (108)..(108): Xaa at position 108 is Gly, Ala, Leu, Val, Ile, Met, Trp, Phe, Ser, Thr, Cys, Tyr, Asn, Glu, Asp, Lys or His
  VARIANT (109)..(109): Xaa at position 109 is Ile, Leu, Ala, Val, Leu, Met, Trp, Phe, Pro, Cys, Asn or Glu
  VARIANT (110)..(110): Xaa at position 110 is Glu, Gly, Ala, Val, Leu, Met, Trp, Ser, Thr, Cys, Tyr, Asp, Arg, or His
  VARIANT (111)..(111): Xaa at position 111 is Tyr, Gly, Ala, Val, Leu, Ile, Met, Trp, Ser, Thr, Cys, Asp, Glu, Lys , Arg or His
  VARIANT (115)..(115): Xaa at position 115 is Asp or Glu
  VARIANT (119)..(119): Xaa at position 119 is Val, Ala, Ile, Leu
  VARIANT (134)..(134): Xaa at position 134 is Ser or Leu
  VARIANT (137)..(137): Xaa at position 137 is Val, Phe, Ala, Leu, Trp, Pro, Ser, Cys, Asp, Glu or Arg
  VARIANT (139)..(139): Xaa at position 139 is Glu or Asp
  VARIANT (141)..(141): Xaa at position 141 is Phe, Val, Leu, Ile, Trp, Ser or Cys
  VARIANT (144)..(144): Xaa at position 144 is Ala, Val, Gly, Ile, Leu or Met
  VARIANT (148)..(148): Xaa at position 148 is Ser, Phe, Thr or Trp
  VARIANT (152)..(152): Xaa at position 152 is Ile, Thr, Leu, Val, Met or Ser
  VARIANT (155)..(155): Xaa at position 155 is Asp or Glu
  VARIANT (179)..(179): Xaa at position 179 is Gly, Val, Trp, Ser, Cys or Arg
  VARIANT (181)..(181): Xaa at position 181 is Ile, Val, Ile or Met
  VARIANT (182)..(182): Xaa at position 182 is Trp, Gly, Ala, Val, Leu, Met, Ser, Cys, Glu or Arg
  VARIANT (188)..(188): Xaa at position 188 is Val or Leu
  VARIANT (196)..(196): Xaa at position 196 is Lys or Glu
  VARIANT (197)..(197): Xaa at position 197 is Thr or Ser
  VARIANT (201)..(201): Xaa at position 201 is Trp, Cys, Tyr, or Phe
  VARIANT (202)..(202): Xaa at position 202 is Lys, Asn or Arg
  VARIANT (203)..(203): Xaa at position 203 is Tyr or Phe
  VARIANT (208)..(208): Xaa at position 208 is Glu or Asp
  VARIANT (214)..(214): Xaa at position 214 is Ile or Leu
  VARIANT (220)..(220): Xaa at position 220 is Ile or Leu
  VARIANT (224)..(224): Xaa at position 224 is Tyr or Phe
  VARIANT (234)..(234): Xaa at position 234 is Glu or Asp
  VARIANT (235)..(235): Xaa at position 235 is Val or Leu
  VARIANT (270)..(270): Xaa at position 270 is Ile, Val, Leu or Met
  VARIANT (296)..(296): Xaa at position 296 is Lys or Glu
  VARIANT (298)..(298): Xaa at position 298 is Ala, Glu, Gly or Asp
  VARIANT (299)..(299): Xaa at position 299 is Glu, Gly, Asp or Ala
  VARIANT (300)..(300): Xaa at position 300 is Ile, Val, Ile or Met
  VARIANT (305)..(305): Xaa at position 305 is Asp or Glu
  VARIANT (317)..(317): Xaa at position 317 is Ala, Ser, Gly or Thr
  VARIANT (323)..(323): Xaa at position 323 is Glu or Asp
  VARIANT (335)..(335): Xaa at position 335 is Glu or Asp
  VARIANT (352)..(352): Xaa at position 352 is Glu or Asp
  VARIANT (359)..(359): Xaa at position 359 is Glu, Gly, Ala, Val, Leu, Trp, Phe, Pro, Ser, Thr, Lys or Arg
  VARIANT (360)..(360): Xaa at position 360 is Asn, Gly, Val, Leu, Ile, Met, Phe, Pro, Thr, Asn, Asp, Lys, Arg or His
  VARIANT (361)..(361): Xaa at position 361 is Ser, Gly, Val, Leu or Glu
  VARIANT (363)..(363): Xaa at position 363 is Asp, Gly, Leu, Ile, Trp or Ser
  VARIANT (364)..(364): Xaa at position 364 is Val, Pro, Ser, Thr, Asn, Gln, Asp, Glu or Lys
  VARIANT (365)..(365): Xaa at position 365 is Leu, Gly, Ala, Val, Ile, Trp, Phe, Pro, Ser, Thr, Cys, Tyr, Gln, Asp, Glu, Arg or His
  VARIANT (367)..(367): Xaa at position 367 is Glu or Lys
  VARIANT (368)..(368): Xaa at position 368 is Gly or Asp
  VARIANT (370)..(370): Xaa at position 370 is Ile, Val, Leu or Met
  VARIANT (373)..(373): Xaa at position 373 is Arg or Ser
  VARIANT (374)..(374): Xaa at position 374 is Asn, Lys, Gln or Arg
  VARIANT (377)..(377): Xaa at position 377 is Leu, Ile, Val or Met
  VARIANT (384)..(384): Xaa at position 384 is Thr, Ala, Ser or Gly
  VARIANT (385)..(385): Xaa at position 385 is Ile, Ser, Leu, Val, Met or Thr
  VARIANT (388)..(388): Xaa at position 388 is Asp or Glu
  VARIANT (393)..(393): Xaa at position 393 is Tyr, Phe or Trp
  VARIANT (398)..(398): Xaa at position 398 is Ala or Val
  VARIANT (414)..(414): Xaa at position 414 is Tyr or Phe
  VARIANT (418)..(418): Xaa at position 418 is Ile or Leu
  VARIANT (419)..(419): Xaa at position 419 is Ser, Asn, Thr or Gln
  VARIANT (423)..(423): Xaa at position 423 is Val or Leu
  VARIANT (425)..(425): Xaa at position 425 is Glu or Val
  VARIANT (427)..(427): Xaa at position 427 is Ile or Val
  VARIANT (434)..(434): Xaa at position 434 is Met or Thr
  VARIANT (481)..(481): Xaa at position 481 is Glu or Asp
  VARIANT (495)..(495): Xaa at position 495 is Asp or Glu
  VARIANT (509)..(509): Xaa at position 509 is Phe, Gly, Ala, Val, Leu, Ile, Met, Trp, Ser, Cys, Tyr, Asn, Asp, Glu or Arg
  VARIANT (512)..(512): Xaa at position 512 is Asn, Ser, Gly, Ala, Leu, Met, Trp, Phe, Ser, Thr, Cys, Gln or Arg
  VARIANT (514)..(514): Xaa at position 514 is Glu, Gly, Ile, Asp or Arg
  VARIANT (516)..(516): Xaa at posioitn 516 is Gly, Ala, Val, Met, Pro, Thr, Asn, Gln, Asp, Glu or Lys
  VARIANT (519)..(519): Xaa at position 519 is Leu, Gly, Ala, Val, Met, Phe, Pro, Tyr, Gln , Asp, Lys or Arg
  VARIANT (526)..(526): Xaa at position 526 is Val or Leu
  VARIANT (530)..(530): Xaa at position 530 is Ile or Leu
  VARIANT (533)..(533): Xaa at position 533 is Val or Ala
  VARIANT (536)..(536): Xaa at position 536 is Ile or Leu
  VARIANT (538)..(538): Xaa at position 538 is Tyr, Phe or Trp
  VARIANT (543)..(543): Xaa at position 543 is Tyr or Phe
  VARIANT (544)..(544): Xaa at position 544 is Lys or Arg
  VARIANT (547)..(547): Xaa at position 547 is Tyr or Phe
  VARIANT (550)..(550): Xaa at position 550 is Tyr, Phe or Trp
  VARIANT (552)..(552): Xaa at position 552 is Asn, Ser, Gln or Thr
  VARIANT (558)..(558): Xaa at position 558 is Phe or Leu
  VARIANT (600)..(600): Xaa at position 600 is Met or Val
  VARIANT (602)..(602): Xaa at position 602 is Met, Ile, Leu or Val
  VARIANT (607)..(607): Xaa at position 607 is Asp or Gly
  VARIANT (610)..(610): Xaa at position 610 is Thr, Lys, Ser or Arg
  VARIANT (612)..(612): Xaa at position 612 is Ile or Thr
  VARIANT (613)..(613): Xaa at position 613 is Leu or Pro
  VARIANT (615)..(615): Xaa at position 615 is Asn or Asp
  VARIANT (619)..(619): Xaa at position 619 is Lys or Arg
  VARIANT (625)..(625): Xaa at position 625 is Tyr, Phe or Trp
  VARIANT (631)..(631): Xaa at position 631 is Ile, Val, Leu or Met
  VARIANT (633)..(633): Xaa at position 633 is Trp or Phe
  VARIANT (646)..(646): Xaa at position 646 is Gln or Arg
  VARIANT (661)..(661): Xaa at position 661 is Asn or Ser
  VARIANT (683)..(683): Xaa at position 683 is Thr, Ala, Ser or Gly
  VARIANT (696)..(696): Xaa at position 696 is Glu or Asp
  VARIANT (700)..(700): Xaa at position 700 is Ser or Gly
  VARIANT (702)..(702): Xaa at position 702 is Phe or Ser

SEQ ID NO: 260 - DNA, 46 bp, Artificial Sequence
  mutagenesis primer
  misc_feature (23)..(24): n is a, c, g, or t
ctcaaacttcaaagtagaaggtnnktatctgaggtggggaaagttc

SEQ ID NO: 261 - DNA, 22 bp, Artificial Sequence
  mutagenesis primer
accttctactttgaagtttgag

SEQ ID NO: 262 - DNA, 45 bp, Artificial Sequence
  mutagenesis primer
  misc_feature (22)..(23): n is a, c, g, or t
aacttcaaagtagaaggtgctnnkctgaggtggggaaagttccat

SEQ ID NO: 263 - DNA, 21 bp, Artificial Sequence
  mutagenesis primer
agcaccttctactttgaagtt

SEQ ID NO: 264 - DNA, 47 bp, Artificial Sequence
  mutagenesis primer
  misc_feature (23)..(24): n is a, c, g, or t
cttcaaagtagaaggtgcttatnnkaggtggggaaagttccatgtgc

SEQ ID NO: 265 - DNA, 22 bp, Artificial Sequence
  mutagenesis primer
ataagcaccttctactttgaag

SEQ ID NO: 266 - DNA, 47 bp, Artificial Sequence
  mutagenesis primer
  misc_feature (23)..(24): n is a, c, g, or t
caaagtagaaggtgcttatctgnnktggggaaagttccatgtgccag

SEQ ID NO: 267 - DNA, 22 bp, Artificial Sequence
  mutagenesis primer
cagataagcaccttctactttg

SEQ ID NO: 268 - DNA, 47 bp, Artificial Sequence
  mutagenesis primer
  misc_feature (23)..(24): n is a, c, g, or t
tgcttatctgaggtggggaaagnnkcatgtgccaggagataaagaca

SEQ ID NO: 269 - DNA, 22 bp, Artificial Sequence
  mutagenesis primer
ctttccccacctcagataagca

SEQ ID NO: 270 - DNA, 45 bp, Artificial Sequence
  mutagenesis primer
  misc_feature (22)..(23): n is a, c, g, or t
tatctgaggtggggaaagttcnnkgtgccaggagataaagacaag

SEQ ID NO: 271 - DNA, 23 bp, Artificial Sequence
  mutagenesis primer
gaactttccccacctcagataag

SEQ ID NO: 272 - DNA, 48 bp, Artificial Sequence
  mutagenesis primer
  misc_feature (23)..(24): n is a, c, g, or t
tctgaggtggggaaagttccatnnkccaggagataaagacaaggaaat

SEQ ID NO: 273 - DNA, 22 bp, Artificial Sequence
  mutagenesis primer
atggaactttccccacctcaga

SEQ ID NO: 274 - DNA, 43 bp, Artificial Sequence
  mutagenesis primer
  misc_feature (22)..(23): n is a, c, g, or t
aggtggggaaagttccatgtgnnkggagataaagacaaggaaa

SEQ ID NO: 275 - DNA, 21 bp, Artificial Sequence
  mutagenesis primer
cacatggaactttccccacct

SEQ ID NO: 276 - protein, 607 aa, Bacillus thuringiensis
MNPNNRSEHDTIKTTENNEVPTNHVQYPLAETPNPTLEDLNYKEFLRMTADNNTEALDSSTTKDVIQKGISVVGDLLGVVGFPFGGALVSFYTNFLNTIWPSEDPWKAFMEQVEALMDQKIADYAKNKALAELQGLQNNVEDYVSALSSWQKNPVSSRNPHSQGRIRELFSQAESHFRNSMPSFAISGYEVLFLTTYAQAANTHLFLLKDAQIYGEEWGYEKEDIAEFYKRQLKLTQEYTDHCVKWYNVGLDKLRGSSYESWVNFNRYRREMTLTVLDLIALFPLYDVRLYPKEVKTELTRDVLTDPIVGVNNLRGYGTTFSNIENYIRKPHLFDYLHRIQFHTRFQPGYYGNDSFNYWSGNYVSTRPSIGSVWPSAVYSGVTKVEFSQYNDQTDEASTQTYDSKRNVGAVSWDSIDQLPPETTDEPLEKGYSHQLNYVMCFLMQGSRGTIPVLTWTHKSVDFFNMIDSKKITQLPLVKAYKLQSGASVVAGPRFTGGDIIQCTENGSAATIYVTPDVSYSQKYRARIHYASTSQITFTLSLDGAPFNQYYFDKTINKGDTLTYNSFNLASFSTPFELSGNNLQIGVTGLSAGDKVYIDKIEFIPVN

SEQ ID NO: 277 - protein, 703 aa, Artificial Sequence
  AfIP-1B-32 variant
  VARIANT (8)..(8): Xaa at position 8 is Ile or Val
  VARIANT (14)..(14): Xaa at position 14 is Ile or Val
  VARIANT (16)..(16): Xaa at position 16 is Val or Ile
  VARIANT (30)..(30): Xaa at position 30 is Leu or Ile
  VARIANT (43)..(43): Xaa at position 43 is Ile or Val
  VARIANT (47)..(47): Xaa at position 47 is Met or Ile
  VARIANT (50)..(50): Xaa at position 50 is Lys or Arg
  VARIANT (52)..(52): Xaa at position 52 is Gln or Asn
  VARIANT (56)..(56): Xaa at position 56 is Thr or Ser
  VARIANT (62)..(62): Xaa at position 62 is Gly or Ala
  VARIANT (63)..(63): Xaa at position 63 is Thr or Ser
  VARIANT (64)..(64): Xaa at position 64 is Ile or Leu
  VARIANT (73)..(73): Xaa at position 73 is Ser or Thr
  VARIANT (75)..(75): Xaa at position 75 is Ile or Val
  VARIANT (76)..(76): Xaa at position 76 is Ala or Ser
  VARIANT (81)..(81): Xaa at position 81 is Ala or Ser
  VARIANT (83)..(83): Xaa at position 83 is Ala or Ser
  VARIANT (99)..(99): Xaa at position 99 is Val or Leu
  VARIANT (122)..(122): Xaa at position 122 is Val or Ile
  VARIANT (135)..(135): Xaa at position 135 is Leu or Val
  VARIANT (139)..(139): Xaa at position 139 is Glu or Asp
  VARIANT (158)..(158): Xaa at position 158 is Met or Val
  VARIANT (160)..(160): Xaa at position 160 is Glu or Asp
  VARIANT (162)..(162): Xaa at position 162 is Val or Leu
  VARIANT (164)..(164): Xaa at position 164 is Ser or Ala
  VARIANT (166)..(166): Xaa at position 166 is Gln or Asn
  VARIANT (171)..(171): Xaa at position 171 is Ser or Thr
  VARIANT (173)..(173): Xaa at position 173 is Gly or Ala
  VARIANT (176)..(176): Xaa at position 176 is Leu or Met
  VARIANT (185)..(185): Xaa at position 185 is Met or Ile
  VARIANT (191)..(191): Xaa at position 191 is Glu or Asp
  VARIANT (192)..(192): Xaa at position 192 is Met or Ile
  VARIANT (208)..(208): Xaa at position 208 is Glu or Asp
  VARIANT (210)..(210): Xaa at position 210 is Ser or Thr
  VARIANT (216)..(216): Xaa at position 216 is Ser or Ala
  VARIANT (217)..(217): Xaa at position 217 is Ser or Ala
  VARIANT (220)..(220): Xaa at position 220 is Ile or Val
  VARIANT (233)..(233): Xaa at position 233 is Ser or Thr
  VARIANT (236)..(236): Xaa at position 236 is Glu or Asp
  VARIANT (241)..(241): Xaa at position 241 is Ala or Ser
  VARIANT (243)..(243): Xaa at position 243 is Ala or Ser
  VARIANT (263)..(263): Xaa at position 263 is Ser or Ala
  VARIANT (264)..(264): Xaa at position 264 is Phe or Tyr
  VARIANT (265)..(265): Xaa at position 265 is Ala or Ser
  VARIANT (268)..(268): Xaa at position 268 is Ser or Thr
  VARIANT (270)..(270): Xaa at position 270 is Ile or Leu
  VARIANT (288)..(288): Xaa at position 288 is Ile or Leu
  VARIANT (292)..(292): Xaa at position 292 is Leu or Val
  VARIANT (309)..(309): Xaa at position 309 is Lys or Arg
  VARIANT (313)..(313): Xaa at position 313 is Ser or Thr
  VARIANT (317)..(317): Xaa at position 317 is Ala or Ser
  VARIANT (318)..(318): Xaa at position 318 is Leu or Ile
  VARIANT (323)..(323): Xaa at position 323 is Glu or Asp
  VARIANT (332)..(332): Xaa at position 332 is Leu or Met
  VARIANT (344)..(344): Xaa at position 344 is Lys or Arg
  VARIANT (347)..(347): Xaa at position 347 is Ile or Leu
  VARIANT (357)..(357): Xaa at position 357 is Val or Leu
  VARIANT (367)..(367): Xaa at position 367 is Glu or Asp
  VARIANT (393)..(393): Xaa at position 393 is Tyr or Phe
  VARIANT (404)..(404): Xaa at position 404 is Ser or Ala
  VARIANT (410)..(410): Xaa at position 410 is Met or Leu
  VARIANT (415)..(415): Xaa at position 415 is Met or Leu
  VARIANT (417)..(417): Xaa at position 417 is Glu or Asp
  VARIANT (442)..(442): Xaa at position 442 is Thr or Ser
  VARIANT (449)..(449): Xaa at position 449 is Ala or Ser
  VARIANT (454)..(454): Xaa at position 454 is Leu or Met
  VARIANT (455)..(455): Xaa at position 455 is Asp or Glu
  VARIANT (461)..(461): Xaa at position 461 is Ser or Ala
  VARIANT (465)..(465): Xaa at position 465 is Val or Ile
  VARIANT (468)..(468): Xaa at position 468 is Ser or Ala
  VARIANT (475)..(475): Xaa at position 475 is Val or Ile
  VARIANT (481)..(481): Xaa at position 481 is Glu or Asp
  VARIANT (486)..(486): Xaa at position 486 is Val or Ile
  VARIANT (490)..(490): Xaa at position 490 is Phe or Tyr
  VARIANT (496)..(496): Xaa at position 496 is Glu or Asp
  VARIANT (520)..(520): Xaa at position 520 is Leu or Met
  VARIANT (526)..(526): Xaa at position 526 is Ile or Val
  VARIANT (530)..(530): Xaa at position 530 is Ile or Val
  VARIANT (536)..(536): Xaa at position 536 is Ile or Val
  VARIANT (538)..(538): Xaa at position 538 is Tyr or His
  VARIANT (545)..(545): Xaa at position 545 is Ala or Ser
  VARIANT (550)..(550): Xaa at position 550 is Tyr or Phe
  VARIANT (559)..(559): Xaa at position 559 is Ser or Ala
  VARIANT (562)..(562): Xaa at position 562 is Ile or Met
  VARIANT (564)..(564): Xaa at position 564 is Met or Val
  VARIANT (574)..(574): Xaa at position 574 is Ile or Val
  VARIANT (585)..(585): Xaa at position 585 is Arg or Lys
  VARIANT (588)..(588): Xaa at position 588 is Leu or Ile
  VARIANT (592)..(592): Xaa at position 592 is Met or Val
  VARIANT (603)..(603): Xaa at position 603 is Lys or Arg
  VARIANT (617)..(617): Xaa at position 617 is Ser or Thr
  VARIANT (634)..(634): Xaa at position 634 is Arg or Lys
  VARIANT (643)..(643): Xaa at position 643 is Ala or Ser
  VARIANT (666)..(666): Xaa at position 666 is Thr or Ser
  VARIANT (667)..(667): Xaa at position 667 is Leu or Val
  VARIANT (685)..(685): Xaa at position 685 is Arg or Lys
  VARIANT (687)..(687): Xaa at position 687 is Ile or Met
  VARIANT (690)..(690): Xaa at position 690 is Thr or Ser
MDIEAKSXNPLMGXTXGSTVLGNDFKPSVXINPITRMITQKEXEMGXSGXSXYVYXDSLNEXXXGFSGAYGPXGXXKFTSXVXVSVSNATASEYKSIKXSYNISMISGIEYIDFDNLTVEDXLNSLSAGPKNLSXKVLXKFIAARDCSGSSIEKDELXKXWXKXLXNFISXYXDGXVVGAIWGGXGSVSTXXTSKKTEDSWKYGETAXFXYSGIGXXVSXAQTYNGSQKDQSXEVXVSCKXLXSGGCVESQVNSWFDVVANKXXXEIXGXSLLDKAPMQSSVSPPPKXPDFXKPEKNAEITEKLDTIKXLGDXEEFXXASGYXEAKKTNPNXTFEEFKSTVRDXNNXDGLNELASKXQENSLDVLAXGSISRRNKNLSLQGVRTISLDSSSDXAVLGAWIANWXDIFPWXSMGYXNXISDAEVAEYILKIRCMMQDLSTLNXIYNTFNXCNIKXXFCHLNXASQXADXFKIAQGXLSDNVXSDDAXEIAXNSLSDXAKKIYTAWNEIGFLRNAELGLGLXIGDQSXSSEXIDVKPXPXPEVTYKXAYCSXGNNNPTAFXSFXKXLPFIDTNGDXYAFGPSLMLLXKAXPEKXIFTKGGEMAMXLTADKDTGILTNDXVKLIPIPYSAAKGIQWXGQGQGRSLXSSQSLQDQFAALEKELGNLNICXXSSDSWSKDWTYTVPYTLXKXSTXYIGTVEKINSIFG

SEQ ID NO: 278 - DNA, 441 bp, Artificial Sequence
  maize codon optimized
atgaccgccaaggacatcgccaccgaggagagcaagatcagggcctacgcgcagtggatcgagatcacgatcttcgtcgtcaactccaacttcaaggtcgagggcgcgtacctgaggtggggcaagttccacgtgcccggagacaaggacaaggagatctcgccgagccagatcaacggcaccatcatcaaggacgaggactcgtacaccatcgcctcctgcggacgcgagaatgcctcgtccgggactgagggcggcttctccctgtacgacggcgacaagctcgtgttcgagtactactgggactgcccttggagcgggtccaactccgacgagctcaccgtcaaggacaaggagaactacacggtgatcaagaagggcggaggtagccctagcggcgcgacaggcaacatcttcatcaccgtcgtcaagaagtcctga

SEQ ID NO: 279 - DNA, 441 bp, Artificial Sequence
  MAIZE CODON OPTIMIZED
atgaccgccaaggatatcgccacggaagagagcaagatcagggcatacgcacagtggatcgagatcaccatcttcgtcgtcaactccaacttcaaggtcgagggtgcgtatctgaggtggggcaagttccacgtgccaggtgacaaggacaaggagatcagcccgagccagatcaacggcaccatcatcaaggacgaggactcgtacaccatcgcatcctgtggacgcgagaatgcctcgtcaggcactgaaggaggcttctccctgtacgacggtgacaagctcgtgttcgagtactactgggactgtccttggagcggatcgaactccgatgagctcaccgtcaaggacaaggagaactacacggtgatcaagaagggtggaggatctcctagcggtgcgacaggcaacatcttcatcaccgtcgtcaagaagtcctga

SEQ ID NO: 280 - DNA, 444 bp, Artificial Sequence
  MAIZE OPTIMIZED CODONS
atggccaccgccaaggacatcgcgaccgaggagagcaagatcagggcctatgcgcagtggatcgagatcacgatcttcgtcgtcaactccaacttcaaggtcgagggcgcgtacctgaggtggggcaagttccacgtgcccggagacaaggacaaggagatctcgccgagccagatcaacggcaccatcatcaaggacgaggactcgtacaccatcgcctcctgcggacgcgagaatgcctcgtccgggactgagggcggcttctccctgtacgacggcgacaagctcgtgttcgagtactactgggactgcccttggagcgggtccaactccgacgagctcaccgtcaaggacaaggagaactacacggtgatcaagaagggcggaggtagccctagcggcgcgacaggcaacatcttcatcaccgtcgtcaagaagtcctga

SEQ ID NO: 281 - DNA, 441 bp, Artificial Sequence
  MAIZE OPTIMIZED CODONS
atgaccgccaaagacatcgcgacggaggagtcgaagatcagagcttatgcgcagtggatcgagatcaccatcttcgttgtcaactcgaacttcaaggtcgagggagcctacctgagatggggcaagttccacgttcccggtgacaaggacaaggagatctcgccgtcccagatcaacggcacgatcatcaaggacgaggactcctacaccatcgccagctgtgggagggagaacgcctcgtcaggcacagagggtggcttcagcctgtacgatggcgacaagctggtcttcgagtactactgggattgcccgtggagcggctcgaacagcgacgagctgaccgtgaaggacaaggagaactacacggtgatcaagaagggtggtggaagcccgtcaggagccaccggcaacatcttcatcacggtggtcaagaagtcctga

SEQ ID NO: 282 - DNA, 441 bp, Artificial Sequence
  MAIZE OPTIMIZED CODONS
atgacggccaaggacacggtcacggaggagagcaagatccgcgcctacgcccagtggatcgagatcaccatcttcgtggttaactccagcttcaaggtcgagggagcctacctgagatggggcaagttccacgtcccaggcgacaaggacaaggagatctcgccatcccagatcgaaggcacggtcatcaaggacgaggagtcgtataccatcgcatcgtgtggcagggagaacgcgtctagcggtaccgagggaggcttcagcctgtacgatggcgacaagctggtcttcgagtactactgggattgcccttggagcggttccaactccgacgagctgagcgtcaaggagaaggagaactacacggtcatcaagaagggtggtggctctcccagcggagccactggcaacatcttcatcacggtcgtcaagaagtcgtga

SEQ ID NO: 283 - DNA, 441 bp, Artificial Sequence
  MAIZE OPTIMIZED CODONS
atgactgccaaggacactgtcaccgaggagtcgaagatccgcgcatacgcccagtggatcgagatcacaatcttcgtcgtcaacagctccttcaaggtggaaggcgcgtacctgaggtggggcaagttccacgtgcctggcgacaaggacaaggagatctcgccaagccagatcgagggtacggtgatcaaggacgaggagagctacaccatcgctagctgtggcagggagaacgcgtcgagcggaacggagggaggctttagcctgtacgacggcgacaagctggtgttcgagtactactgggactgcccttggtcaggctcgaactccgatgagctcagcgtcaaggagaaggagaactacacggtcatcaagaagggcggtggatcaccgtcaggtgccactgggaacatcttcatcacggtcgtgaagaagtcctga

SEQ ID NO: 284 - DNA, 441 bp, Artificial Sequence
  MAIZE OPTIMIZED CODONS
atgaccgccaaggacactgtcacggaggagtccaagatcagggcgtacgcgcagtggatcgagatcacgatcttcgtcgtcaactccagctttaaggtcgagggagcatacctgcgctggggcaagtttcacgtgcccggcgacaaggacaaggagatctcgccctcccagatcgaagggacggtcatcaaggacgaggagtcgtacacgatcgcctcctgcggacgggagaacgctagctcagggacggaaggtggcttcagcctgtacgacggcgacaagctggtcttcgagtactactgggactgcccgtggtcaggctcgaactccgatgagctgagcgtgaaggagaaggagaactacaccgtgatcaagaagggcggtggatcaccatctggcgccactggcaacatcttcatcaccgtggtgaagaagtcgtga

SEQ ID NO: 285 - DNA, 441 bp, Artificial Sequence
  MAIZE OPTIMIZED CODONS
atgacggccaaggacactgtgaccgaagagtccaaaatccgcgcctacgcccagtggatcgagatcaccatcttcgtggttaactccagcttcaaggtcgagggagcctacctgaggtggggcaagttccacgtgcctggcgacaaggacaaggagatctcgccatcccagatcgagggcacggtcatcaaggacgaggagagctacacgatcgcctcgtgcggtagggagaacgcgagctctgggacggaaggaggctttagcctgtacgatggcgacaagctggtcttcgagtactactgggattgcccgtggagcggctccaactcggacgagctgagcgtcaaggagaaggagaactacacggtgatcaagaagggtggcggtagcccttctggagcgactggcaacatcttcatcacggtcgtcaagaagtcctga

SEQ ID NO: 286 - DNA, 441 bp, Artificial Sequence
  MAIZE OPTIMIZED CODONS
atgaccgccaaggataccgtcaccgaggagtccaagatccgcgcatacgcccagtggatcgagatcacgatcttcgtcgtgaacagctcgttcaaggtcgagggagcctacctgaggtggggcaagtttcacgtgccaggcgacaaggacaaggagatctcgccgagccagatcgaagggacggtcatcaaggacgaggagtcctacacgatcgcctcctgtggcagggagaatgcgagctcaggcaccgagggaggcttcagcctgtacgatggcgacaaactggtcttcgagtactactgggactgtccgtggagcggctcgaactccgacgagctgagcgtcaaggagaaggagaactacacggtcatcaagaagggtggtggaagcccatctggagccacgggcaacatcttcatcacggtcgtcaagaagtcgtga

SEQ ID NO: 287 - DNA, 441 bp, Artificial Sequence
  MAIZE OPTIMIZED CODONS
atgaccgccaaggatatcgccacggaagagagcaagatcagggcctacgcacagtggatcgagatcaccatcttcgtcgtcaactccaacttcaaggtcgagggtgcgtatctgaggtggggcaagttccacgtgccaggtgacaaggacaaggagatcagcccgagccagatcaacggcaccatcatcaaggacgaggactcgtacaccatcgcatcctgtggacgcgagaatgcctcgtcaggcactgaaggaggcttctccctgtacgacggtgacaagctcgtgttcgagtactactgggactgtccttggagcggatcgaactccgatgagctcaccatcaaggacaaggagaactacacggtgatcaagaagggtggaggatctcctagcggtgcgacaggcaacatcttcatcaccgtcgtcaagaagtcctga

SEQ ID NO: 288 - DNA, 441 bp, Artificial Sequence
  MAIZE OPTIMIZED CODONS
atgaccgccaaggatatcgccaccgaggagagcaagatcagggcctacgcgcagtggatcgagatcacgatcttcgtcgtcaactccaacttcaaggtcgagggcgcgtacctgaggtggggcaagttccacgtgcccggagacaaggacaaggagatctcgccgagccagatcaacggcaccatcatcaaggacgaggactcgtacaccatcgcctcctgcggacgcgagaatgcctcgtccgggactgagggcggcttctccctgtacgacggcgacaagctcgtgttcgagtactactgggactgcccttggagcgggtccaactccgacgagctcaccatcaaggacaaggagaactacacggtgatcaagaagggcggaggtagccctagcggcgcgacaggcaacatcttcatcaccgtcgtcaagaagtcctga

SEQ ID NO: 289 - DNA, 441 bp, Artificial Sequence
  MAIZE OPTIMIZED CODONS
atgaccgccaaggatatcgccacggaagagagcaagatcagggcatacgcacagtggatcgagatcacgatcttcgtcgtcaactccaacttcaaggtcgagggtggctatctgaggtggggcaagttccacgtgccaggtgacaaggacaaggagatcagcccgagccagatcaacggcaccatcatcaaggacgaggactcgtacaccatcgcatcctgtggacgcgagaatgcctcgtcaggcactgaaggaggcttctccctgtacgacggtgacaagctcgtgttcgagtactactgggactgtccttggagcggatcgaactccgatgagctcaccgtcaaggacaaggagaactacacggtgatcaagaagggtggaggatctcctagcggtgcgacaggcaacatcttcatcaccgtcgtcaagaagtcctga

SEQ ID NO: 290 - DNA, 441 bp, Artificial Sequence
  MAIZE OPTIMIZED CODONS
atgaccgccaaggatatcgccaccgaggagagcaagatcagggcctacgcgcagtggatcgagatcacgatcttcgtcgtcaactccaacttcaaggtcgagggcggctacctgaggtggggcaagttccacgtgcccggagacaaggacaaggagatctcgccgagccagatcaacggcaccatcatcaaggacgaggactcgtacaccatcgcctcctgcggacgcgagaatgcctcgtccgggactgagggcggcttctccctgtacgacggcgacaagctcgtgttcgagtactactgggactgcccttggagcgggtccaactccgacgagctcaccgtcaaggacaaggagaactacacggtgatcaagaagggcggaggtagccctagcggcgcgacaggcaacatcttcatcaccgtcgtcaagaagtcctga

SEQ ID NO: 291 - DNA, 441 bp, Artificial Sequence
  MAIZE OPTIMIZED CODONS
atgaccgccaaggatatcgccaccgaggagagcaagatcagggcctacgcgcagtggatcgagatcacgatcttcgtcgtcaactccaacttcaaggtcgagggcggctacctgaggtggggcaagttccacgtgcccggagacaaggacaaggagatctctccgagccagatcaacggcaccatcatcaaggacgaggactcgtacaccatagcctcctgcggacgcgagaatgcctcgtccgggactgagggtggattctccctgtacgacggcgacaagctcgttttcgagtactactgggactgcccttggagcggatcgaactccgacgagctcaccgtcaaggacaaggagaactacacggtgatcaagaagggcggaggtagccctagcggcgcgacaggcaacatcttcatcaccgtcgtcaagaagtcttaa

SEQ ID NO: 292 - DNA, 2112 bp, Artificial Sequence
  MAIZE OPTIMIZED CODONS
atggatatcgaggccaagtcgatcaacccactgatgggaatcaccgtcggtagcaccgtcttgggcaacgacttcaagccgagcgtcctgatcaacccgatcacgaggatgatcactcagaaggaggtcgagatgggcatgtctggcaagtcgcagtacgtctacaccgactccctgaacgagggtaccataggcttcagcggagcgtacggaccgtcaggcatagccaagttcacgtccgccgtcgccgtcagcgtgtccaacgcgactgccagcgagtacaagtccatcaaggtctcctacaacatctcgatgatcagcggcatcgagtacatcgacttcgacaacctcacggtggaagacgtcctgaactcgctctcagctggaccgaagaacttgagcctgaaggtcctcgagaagttcatcgctgcgagagactgcagcggctcgtccatcgagaaggacgagctcatgaaggagtgggtcaagtccctgcagaacttcatcagctcctacggcgacggattggtcgtcggagccatatggggaggcatgggatcagtcagcaccgagatgacgtccaagaagaccgaggactcctggaagtacggcgagactgccgagttcagctactcaggcatcggtagctcagtctccatcgcccagacgtacaacggctcgcagaaggaccagtcctctgaggtcgaagtctcctgcaaggcactcgcgtcaggaggctgcgtcgaatcacaggtcaacagctggttcgacgtcgtcgccaacaagtccttcgccgagatttccggcatctcactgctcgacaaggcgccgatgcagtcatctgtcagcccacctccgaagatcccagacttcctgaagccggagaagaacgctgagatcaccgagaagctggacacgatcaagaagctcggtgacagcgaggagttcgcactcgcatcaggctacgaggaggccaagaagacgaacccgaacctcaccttcgaggagttcaagagcacggtccgcgacaagaacaacatcgacggtctgaacgagctcgcatccaaggtccaagagaactcgctcgacgtccttgcagagggatcgatctcccgcaggaacaagaacctgagcctgcaaggcgtcaggactatcagcctggactctagctcagactacgcagtgctcggagcatggatcgccaactggagcgacatcttcccgtggatgagcatgggctacatgaacgagatctccgacgctgaggtcgcagagtacatcctcaagatccgctgcatgatgcaggacctcagcactctgaacacgatctacaacacgttcaacgcctgcaacatcaagctcgacttctgccacctgaactccgctagccaggtcgccgacagcttcaagatcgcgcaaggagtcctctcggacaacgtcgagtcggacgacgctgtcgagatcgcgttcaactcgcttagcgacgaggcgaagaagatctacacggcttggaacgagatcggcttcctccgcaacgcggaactcggcctcggacttctcatcggtgaccagagcgtctccagcgagatcatcgacgtcaagccgatcccctacccggaagtgacctacaaggcggcgtactgcagctatggcaacaacaaccctacggcgttctcgagcttcatcaagatgctgcccttcatcgacacgaacggcgacatctacgccttcggacctagcctgatgctcctccgcaaggctctgcccgagaagatgatcttcaccaagggtggcgagatggccatgaagctgacagccgacaaggacaccggcatcctgacgaacgatagcgtcaagctcatccccataccctactcagcggccaagggcatccagtggagaggtcaaggacagggtagatcactggccagctctcagagcctccaagaccagttcgcagcactggagaaggagctcggcaacctcaacatctgcacactgagctccgactcctggtcgaaggactggacgtacacggtgccgtacaccctcaggaagatcagcactacgtacatcggcacggtggagaagatcaactcgatcttcggctga

SEQ ID NO: 293 - DNA, 2112 bp, Artificial Sequence
  MAIZE OPTIMIZED CODONS
atggatatcgaggcgaagtcgatcaacccgctgatggggatcaccgttggcagcaccgtccttggcaacgacttcaagccctccgtcctgatcaacccgatcactcggatgatcactcagaaggaggtcgagatgggcatgtccggcaagtcccagtacgtgtacacggatagcctcaacgagggcacgattggcttcagcggagcgtatggaccgtcaggtatcgccaagttcacgtcagcggtcgcagtctcagtctccaacgcgactgcatccgagtacaagagcatcaaggtctcctacaacatctccatgatcagcggtatcgagtacatcgacttcgacaacctcaccgtggaagacgtcctcaactcgctcagcgctggacccaagaacctgtcactgaaggtcctggagaagttcatcgcagcgagagactgctccggatcatccatcgagaaggacgagttgatgaaggagtgggtcaagtccctgcagaacttcatctccagctacggagacggactggtcgtcggagccatctggggaggcatgggatcagtcagcacggagatgacgagcaagaagactgaggactcctggaagtacggcgagactgccgagttcagctactcaggcatcggcagctcagtgtcgatcgcgcagacgtacaacggcagccagaaggaccagtccagcgaggtcgaggtcagctgcaaggctctcgcatcaggaggctgcgtcgagagccaagtgaactcctggttcgacgtggtcgccaacaagtccttcgccgagatcagcggcatcagcctgctcgacaaggctccgatgcagagctccgtcagccctccaccgaagatcccagacttcctcaagcccgagaagaacgctgagatcaccgagaagctggacacgatcaagaagctgggcgactcggaggagttcgcacttgcctcaggctacgaggaggccaagaagaccaacccgaacctgaccttcgaggagttcaagtccacagtccgcgacaagaacaacatcgatggactcaacgagctcgcgtcgaaggtccaggagaactcccttgacgtcctcgccgaaggctccatctccagacgcaacaagaacctctcgctccaaggcgtcaggacgatctccctggactcatcatcggactacgcagtcctgggagcatggatcgccaactggagcgacatcttcccgtggatgagcatgggctacatgaacgagatctcggacgctgaggtcgctgagtacatcctgaagatccgctgcatgatgcaagacctctccacgctcaacacgatctacaacacgttcaacgcgtgcaacatcaagctcgacttctgccacctcaacagcgcctcgcaggtcgccgactcgttcaagatcgctcagggagtcctgtccgacaacgtcgagtccgacgacgccgttgagatcgcattcaactctctgagcgacgaggccaagaagatctacaccgcgtggaacgagatcgggttcttgcgcaacgcggagcttggactcggactgctgatcggagaccagtctgtcagcagcgagatcatcgacgtcaagccgataccgtacccagaggtcacctacaaggcggcgtactgctcatacgggaacaacaaccctacggccttcagctcgttcatcaagatgctcccgttcatcgacaccaacggtgacatctacgccttcggaccttcactcatgctcctgcgcaaggctctgcccgagaagatgatcttcaccaagggtggcgagatggccatgaagctcaccgcggacaaggacactggcatcctgacgaacgacagcgtcaagttgatcccgataccgtactcagctgccaagggcatacagtggagaggccagggtcaaggcagatccctcgcatcaagccagtcgctgcaggaccagttcgcagccttggagaaggagctcggcaacctgaacatctgcaccctgagctcggactcctggtcgaaggactggacctacacggtcccgtacacccttcgcaagatctccaccacctacatcggcacggtcgagaagatcaactccatcttcggctga

SEQ ID NO: 294 - DNA, 2112 bp, Artificial Sequence
  MAIZE OPTMIZED CODONS
atggacatcgaggccaagtcgatcaacccgctcatgggcatcacggtgggctccacggtgctgggcaacgacttcaaaccgtccgtcctcatcaacccgatcacgcggatgatcacccagaaggagatcgagatgggcatgtcgggcaagagccagtacgtgtacaccgactccctcaacgagggcacgatcgggttcagcggcgcctacggaccgtccgggatcgccaagttcacgagcgccgtggcagtctcggtctcgaacgccaccgccagcgagtacaagtccatcaaggtctcctacaacatctccatgatctccggcatcgagtacatcgacttcgacaacctgacggtcgaggacgtgctcaacagcctcagcgcaggtccgaagaacctcagcctgaaggtcctggagaagttcatcgccgcaagggactgctccggcagctccatcgagaaggacgagctgatgaaggagtgggtcaagtccctccagaacttcatcagcagctacggcgacgggctggtggtcggagctatctggggagggatgggctccgtgtccacggagatgacctccaagaagacggaggactcctggaagtacggcgagaccgccgagttctcctactccggcatcggcagctccgtcagcattgcgcagacgtacaacgggagccagaaggaccagagctccgaggtggaggtctcctgcaaggcactcgcgtccggaggatgcgtcgagagccaggtcaactcctggttcgacgtcgtcgccaacaagtcgttcgcggagatcagcggcatctccctgctcgacaaggcgcccatgcagtccagcgtgtctccaccgccgaagatcccggacttcctgaagcccgagaagaacgcggagatcaccgagaagctcgacacgatcaagaagctgggcgactcggaggagttcgcgcttgcgtccggctacgaggaggccaagaagaccaacccgaacctcaccttcgaggagttcaagagcacggtccgggacaagaacaacatcgacggcctcaacgagctggcctcgaaggtgcaggagaactccctggacgtgctcgccgagggcagcatcagccggcgcaacaagaacctgtcgctgcaaggcgtgcggaccatctcgctcgactccagctccgactacgcggtcctgggagcgtggattgcgaactggagcgacatcttcccgtggatgagcatgggctacatgaacgagatctccgacgccgaggtcgcggagtacatcctgaagatccgctgcatgatgcaggacctgtcgaccctgaacacgatctacaacaccttcaacgcgtgcaacatcaagctcgacttctgccacctcaacagcgccagccaagtcgcggactccttcaagatcgcgcagggcgtcctcagcgacaacgtcgagtccgacgatgccgtcgagatcgcgttcaactcgctctcggacgaggccaagaagatctacacggcgtggaacgagatcgggttcctgcggaacgccgagctgggtctcggactcctgatcggcgaccagtcggtgtcgagcgagatcatcgacgtcaagcccatcccgtacccggaggtgacctacaaggcggcgtactgcagctacggcaacaacaacccgacggcgttctcctccttcatcaagatgctgccgttcatcgacaccaacggcgacatctacgccttcgggccatccctgatgctgctccgcaaggccctgcccgagaagatgatcttcacgaagggtggcgagatggccatgaagctcacggccgacaaggacaccggcatcctcacgaacgactccgtgaaactcatcccgatcccgtacagcgctgccaaaggcatccagtggcgcggtcagggtcaaggcaggtcgctcgccagctcgcaaagcctccaggaccagttcgcggcgctggagaaggagctgggcaacctgaacatctgcaccctgtcgtcggactcctggtccaaggactggacctacacggtgccctacacgctgcgcaagatctcgaccacctacatcgggacggtcgagaagatcaactccatcttcggctga

SEQ ID NO: 295 - DNA, 2112 bp, Artificial Sequence
  MAIZE OPTIMIZED CODONS
atggacatagaggccaaatcgatcaacccactcatgggcatcaccgtcggcagcaccgtcctcggcaacgacttcaagccctccgtcctcatcaacccaatcacgcgcatgatcacgcagaaggagatcgagatgggcatgtcgggcaagagccagtacgtctacaccgactcgctgaacgagggtaccatcgggttcagcggagcttacggacctagcgggatagcgaagttcacctcagcggttgccgtctccgtctcgaatgcgacggcctccgagtacaagtccatcaaggtctcctacaacatctccatgatctcgggcatcgagtacatcgacttcgacaacctgaccgtcgaggacgtcctgaactccctgtcagctggacccaagaacctgtcgctcaaggtgctggagaagttcatcgccgctagggactgcagcggatcgagcatcgagaaagacgagctcatgaaggagtgggtcaagagcctgcagaacttcatctcctcgtacggcgatggactggtcgttggagcgatctggggaggcatgggaagcgtgtccacggagatgacgtccaagaagacggaggactcctggaagtacggcgagacagcggagttctcgtactcagggataggcagcagcgtgtcgatcgcacagacctacaatggcagccagaaggaccagagctcggaggtcgaggtgtcttgcaaggcccttgcgagtggaggctgcgtcgaatcgcaggtcaactcgtggttcgacgtggtcgccaacaagtccttcgccgagatctcagggatctcgctgctcgacaaggctcccatgcagagctccgtgagcccacctccgaagatcccggacttcctgaaacccgagaagaacgccgagatcacggagaagctcgacacgatcaagaagctcggcgactccgaggagtttgcccttgcatccggctacgaggaggccaagaagacgaacccgaacctgacgttcgaggagttcaagagcacggtccgcgacaagaacaacatcgacgggctcaatgagctggcctcgaaggtccaggagaactcgctcgacgtgctcgccgaaggctcgatctctaggcgcaacaagaacctgtccctgcaaggtgtcaggacgatctctctcgactccagcagcgactatgcagtgcttggagcgtggatagccaactggtccgacatcttcccgtggatgtcgatgggctacatgaacgagatcagcgacgcagaggtcgcggagtacatcctcaagatccgctgcatgatgcaggacctgagcaccctcaacacgatctacaacacgttcaacgcgtgcaacatcaagctggacttctgccacctgaacagcgcctcgcaagttgcggacagcttcaagatcgcccagggagtcctcagcgacaacgtcgagagcgacgacgctgtcgagatcgcgttcaacagcctctcggatgaggcgaagaagatctacacggcatggaacgagatcggcttcctgcgcaatgcggaactcggacttggactgctcataggcgaccagagtgtgtcctccgagatcatcgacgtcaagcccataccgtaccctgaggtgacctacaaggctgcctactgcagctacgggaacaacaacccgactgccttctcgagcttcatcaagatgctgcccttcatcgacaccaacggcgacatctacgccttcggacccagcctcatgctcctgcgtaaagccctgcccgagaagatgatcttcacgaagggtggcgagatggccatgaagctcaccgccgacaaggacacgggcatcctcaccaacgactccgtgaaactcatcccgataccgtactcggctgccaaaggcatccagtggagaggtcaaggccagggtagaagccttgcgagctctcagtcactccaagaccagttcgcagccctggagaaggagcttggcaacctcaacatctgcaccctgagctccgactcatggtccaaggactggacgtacaccgttccgtacaccctgcggaagatcagcacgacctacatcggaaccgtcgagaagatcaactccatcttcgggtga

SEQ ID NO: 296 - DNA, 2112 bp, Artificial Sequence
  MAIZE OPTIMIZED CODONS
atggacatagaggccaaatcgatcaacccgctcatgggcatcaccgtcggatctaccgtcctcgggaacgacttcaagccctccgtcctcatcaaccctatcactcgcatgatcacccagaaggagatcgagatgggcatgtccgggaagtcccagtacgtgtacacggattcgctcaacgagggtacgatcgggttctccggagcctatggaccgtcaggcatcgctaagttcacgagcgcggttgcagtgtcggtctccaatgccactgcctcggagtacaagtcgatcaaggtgtcctacaacatctcgatgatcagcgggatcgagtacatcgacttcgacaacctcacggtcgaggatgtgctgaacagcctctcagcaggtcccaagaacctctccctcaaagtgctggagaagttcatcgccgctagggactgctcgggttcgagtatcgagaaggacgagctgatgaaggagtgggtcaagtccctgcagaacttcatcagcagctacggtgacggactggtcgttggcgctatctggggaggcatgggaagcgtctcgacggagatgacgtcgaagaagacggaggactcgtggaagtacggcgaaacggctgagttctcctacagcggcatagggtcatccgtctcgatcgcccagacctacaacggctcgcagaaagaccagtcctccgaggtcgaagtcagctgcaaagcccttgcatcgggaggatgcgttgagtcccaggtcaactcatggttcgacgtggtcgccaacaagtcgttcgcggagatcagcggcatctcgctcctcgacaaagcgcctatgcagagcagcgtgtcaccgcctccgaagatcccggacttcctgaagcccgagaagaacgcggagatcacggagaagctggacacgatcaagaagctcggcgatagcgaggagttcgcactcgcatccggctacgaggaggcgaagaagaccaacccgaacctgaccttcgaggagttcaagtccacggtccgcgacaagaacaacatcgacggcctgaacgagctcgcgagcaaagtgcaggagaactctctggacgtgctggcggaaggctcgatctcgcgtcgcaacaagaacctcagcctccagggcgtcaggacgatctcgctcgacagcagcagcgactacgctgtcctcggagcgtggatcgccaactggagcgacatcttcccgtggatgagcatgggctacatgaacgagatcagcgacgccgaagtcgccgagtacatcctgaagatccggtgcatgatgcaagacctctccaccctcaacacgatctacaacacgttcaacgcctgcaacatcaagctggacttctgccacctcaactccgcatcccaagtcgcggacagcttcaagatcgcgcaaggtgtgctgtccgacaacgtcgagagcgacgatgccgtcgagatcgcgttcaactccctctccgacgaggcgaagaagatctacaccgcttggaacgagatcgggttcctcaggaacgcggagctcggacttggcctcctcattggcgaccagagcgtgagctccgagatcatcgacgtgaagcccataccgtatccggaggtcacctacaaggctgcctactgctcctacggcaacaacaacccgaccgcgttctcgagcttcatcaagatgctcccgttcatcgacacgaacggcgacatctacgccttcggaccatccctgatgctcctgaggaaggcacttccggagaagatgatcttcacgaagggcggtgagatggcgatgaagctcacggccgacaaggacacgggcatcctgacgaacgactcggtcaagctcatacccatcccgtactcggcagccaaaggcatccagtggagagggcaaggtcagggcagatcactggcatccagccagagtctccaggaccagtttgcagccctggagaaggagctgggcaacctgaacatctgcacgctgtcgagcgactcgtggagcaaggattggacctacacggttccctacacgctgcgcaagatctcgaccacctacatcggcaccgtcgagaagatcaacagcatcttcgggtga

SEQ ID NO: 297 - DNA, 2112 bp, Artificial Sequence
  MAIZE OPTIMIZED CODONS
atggatatcgaggccaagtcgatcaacccgctgatgggtatcaccgtcggcagcaccgtcctcggcaatgacttcaagccaagcgtcctgatcaacccgatcacgcggatgatcactcagaaggagatcgagatgggcatgtccggcaagtcccagtacgtgtacacggactccctgaacgagggcacgatcggcttcagcggagcatacggaccgtccgggatagccaagttcaccagcgcagtcgcagtgagcgtctcgaacgcgacggcgtcggagtacaagtcgatcaaggtcagctacaacatctcgatgatcagcggcatcgagtacatcgacttcgacaacctgaccgtcgaggacgtcctcaactcgctgagcgcaggtcccaagaacctcagcctcaaggtgctggacaagttcatcgcagccagggactgcagcggcagctcgatcgagaaggaggagctgatgaaggagtgggtcaagtcgctccagaacttcatctcgtcctacggcgacggactggtcgtcggagcgatatggggaggtatgggatcagtctcgaccgagatgacgtccaagaagacggaggactcgtggaagtacggcgaaaccgcggagttcagctactcgggcattggcagctccgtcagcatagcgcagacgtacaacggctcccagaaggaccagtccagcgaggtggaggtcagctgcaaggcactcgcgtcaggagggtgcgtcgagtcgcaggtcaactcctggtttgacgtcgtggccaacaagtcgttcgccgagatctccgggatcagcctgctcgacaaagcgcccatgcagtccagcgtgagcccacctccgaagatcccggacttcctgaagcccgagaagaacgcggagatcacggagaagctggagacgatcaagaagctcggcgacagcgaggagtttgcactggcaagcggctacgaggaggcgaagaagacgaacccgaacctgaccttcgaggagttcaagtccacggtgcgcgacaagaacaacatcgacggcctcaatgagctggcgtcgaaggttcaggagaactcgctcgacgtgctcgcagaaggctccatctcgcgcaggaacaagaacctctccctgcaaggcgtgagaaccatcagcctcgagagctcctccgactacgcagtccttggagcctggatcgccaactggagcgacatcttcccttggatgagcatgggctacatgaacgagatctccgacgctgaggtcgctgagtacatcctcaagatccgctgcatgatgcaagatctctccaccctgaacacgatctacaacacgttcaacgcctgcaacatcaagctcgacttctgccacctgaactcggcaagccaagtcgccgactcgttcaagatcgcgcagggagtcctgtcggacaacgtggagtcggacgacgcagtggagatcgcgttcaactcgctctcggacgaggcgaagaagatctacacggcgtggaacgagattgggttcctgcgcaatgccgaactgggactcggactccttatcggagaccagtcagtcagctccgagatcatcgacgtcaagcctatcccattcccagaggtgacctacaaggctgcctactgcagctacgggaacaacaacccgactgccttcagctccttcatcaagatgctgcccttcatcgacacgaacggcgacatctacgcgttcggacctagcctgatgctgctccgcaaggcactcccggagaagatgatcttcacgaagggcggcgagatggccatgaagctgacggcggacaaggacaccggcattctcaccaacgactcggtgaagctgatcccgatcccttacagcgccgctaagggcatccagtggagaggtcaaggtcaaggtagaagcttggcctcaagccagtccctccaggaccagtttgccgcactcgagaaggagctgggcaacctgaacatctgcaccctgtcctcagactcgtggtctaaggactggacgtacaccgtgccgtataccctgaggaagatctccacgacctacatcggcaccgtcgagaagatcaactccatcttcggctga

SEQ ID NO: 298 - DNA, 2112 bp, Artificial Sequence
  MAIZE OPTIMIZED CODONS
atggatatcgaagccaagtcgatcaacccgctgatgggaatcacggtgggctcgaccgtcctcgggaacgacttcaagccgagcgtcctgatcaacccgatcaccaggatgatcacgcagaaggagatcgagatggggatgtccggcaagtcgcagtacgtctacacggactccctcaacgagggcactatcgggttcagcggagcgtatggaccatccgggatcgcgaagttcacgagcgcagtcgcagtctcagtgtccaacgccacggcgtccgagtacaagtcgatcaaggtgagctacaacatctccatgatcagcgggatcgagtacatcgatttcgacaacctcaccgtcgaggatgtcctgaactcgctgagcgcaggtcccaagaacctgtccctgaaggtcctcgacaagttcatcgcggccagggactgctcaggctcctccatcgagaaggaggagctcatgaaggagtgggtcaagagcctgcagaacttcatcagctcctacggcgacggactcgttgtcggagccatatggggaggcatgggcagcgtgtccaccgagatgacgtcgaagaagaccgaggactcctggaagtacggcgagacggcagagttctcgtactcgggcataggctcatccgtgtcgatcgcacagacgtacaacgggtcgcagaaggaccagtcgtctgaggtcgaggtcagctgcaaagcgctcgcatctggagggtgcgtcgagagccaggtcaactcctggttcgacgtggtcgcgaacaagtccttcgcggagatctcagggatctcactgctggacaaagcgccgatgcaaagctccgtttctccgcctccgaagatcccggacttcctcaagcccgagaagaacgccgagatcaccgagaagctggagacgatcaagaagctgggcgactcggaggagttcgcattggcctcgggctacgaggaggccaagaagaccaacccgaacctgacgttcgaggagttcaagtcgaccgtgagggacaagaacaacatcgacgggcttaacgagctcgcgtccaaggtgcaggagaattcgctcgacgtgctggctgaaggcagcatctcgaggcgcaacaagaacctgtcgctccaaggagtcaggacgatctccctggagtccagctccgactacgcagtcttgggcgcatggatcgctaactggtccgacatctttccctggatgtcgatgggctacatgaacgagatctccgacgctgaagtggccgagtacatcctgaagatccgctgcatgatgcaagacctcagcacgctcaacaccatctacaacaccttcaacgcgtgcaacatcaagctcgacttctgccacctgaactccgcgtcacaagtcgccgactccttcaagatcgctcagggagtgctgtccgacaacgttgagtccgacgatgccgtcgagatcgcattcaactccctgtcggacgaggccaagaagatctacaccgcctggaacgagatcggcttcctgcgcaatgcggaactcggacttggactcctgatcggtgaccagagcgtcagcagcgagatcatcgacgtgaaacccataccgttcccagaggtcacctacaaggctgcctactgctcgtacggcaacaacaaccctacggcgttctcgagcttcatcaagatgctgcccttcatcgacaccaatggcgacatctacgcgttcggacccagcctgatgctcctgaggaaagcactgccggagaagatgatcttcacgaagggcggcgagatggctatgaagctgaccgcggacaaggacaccggcatccttacgaacgactcggtgaagctgataccgattccgtacagcgctgcaaagggcatccagtggagaggccaaggtcaaggcaggtcactcgcgtcaagccagagcctccaggatcagttcgcagccttggagaaggagctgggcaacctgaacatctgcacgctctcctcggactcctggagcaaggactggacctacaccgttccgtacacccttcgcaagatcagcacgacgtacatcggaacggtcgagaagatcaactcgatcttcggctga

SEQ ID NO: 299 - DNA, 2112 bp, Artificial Sequence
  MAIZE OPTIMIZED CODONS
atggatatcgaggccaagtcgatcaacccactgatgggaatcaccgtcggtagcaccgtcttgggcaacgacttcaagccgagcgtcctgatcaacccgatcacgaggatgatcactcagaaggagatcgagatgggcatgtctggcaagtcgcagtacgtctacaccgactccctgaacgagggtaccataggcttcagcggagcgtacggaccgtcaggcatagccaagttcacgtccgccgtcgccgtcagcgtgtccaacgcgactgccagcgagtacaagtccatcaaggtctcctacaacatctcgatgatcagcggcatcgagtacatcgacttcgacaacctcacggtggaagacgtcctgaactcgctctcagctggaccgaagaacttgagcctgaaggtcctcgacaagttcatcgctgcgagagactgcagcggctcgtccatcgagaaggaggagctcatgaaggagtgggtcaagtccctgcagaacttcatcagctcctacggcgacggattggtcgtcggagccatatggggaggcatgggatcagtcagcaccgagatgacgtccaagaagaccgaggactcctggaagtacggcgagactgccgagttcagctactcaggcatcggtagctcagtctccatcgcccagacgtacaacggctcgcagaaggaccagtcctctgaggtcgaagtctcctgcaaggcactcgcgtcaggaggctgcgtcgaatcacaggtcaacagctggttcgacgtcgtcgccaacaagtccttcgccgagatttccggcatctcactgctcgacaaggcgccgatgcagtcatctgtcagcccacctccgaagatcccagacttcctgaagccggagaagaacgctgagatcaccgagaagctggagacgatcaagaagctcggtgacagcgaggagttcgcactcgcatcaggctacgaggaggccaagaagacgaacccgaacctcaccttcgaggagttcaagagcacggtccgcgacaagaacaacatcgacggtctgaacgagctcgcatccaaggtccaagagaactcgctcgacgtccttgcagagggatcgatctcccgcaggaacaagaacctgagcctgcaaggcgtcaggactatcagcctggagtctagctcagactacgcagtgctcggagcatggatcgccaactggagcgacatcttcccgtggatgagcatgggctacatgaacgagatctccgacgctgaggtcgcagagtacatcctcaagatccgctgcatgatgcaggacctcagcactctgaacacgatctacaacacgttcaacgcctgcaacatcaagctcgacttctgccacctgaactccgctagccaggtcgccgacagcttcaagatcgcgcaaggagtcctctcggacaacgtcgagtcggacgacgctgtcgagatcgcgttcaactcgcttagcgacgaggcgaagaagatctacacggcttggaacgagatcggcttcctccgcaacgcggaactcggcctcggacttctcatcggtgaccagagcgtctccagcgagatcatcgacgtcaagccgatcccctttccggaagtgacctacaaggcggcgtactgcagctatggcaacaacaaccctacggcgttctccagcttcatcaagatgctgcccttcatcgacacgaacggcgacatctacgccttcggacctagcctgatgctcctccgcaaggctctgcccgagaagatgatcttcaccaagggtggcgagatggccatgaagctgacagccgacaaggacaccggcatcctgacgaacgatagcgtcaagctcatccccataccctactcagcggccaagggcatccagtggagaggtcaaggacagggtagatcactggccagctctcagagcctccaagaccagttcgcagcactggagaaggagctcggcaacctcaacatctgcacactgagctccgactcctggtcgaaggactggacgtacacggtgccgtacaccctcaggaagatcagcactacgtacatcggcacggtggagaagatcaactcgatcttcggctga

SEQ ID NO: 300 - DNA, 2112 bp, Artificial Sequence
  MAIZE OPTIMIZED CODONS
atggatatcgaggccaagtcgatcaacccgctgatgggaatcaccgtcggtagcaccgtcttgggcaacgacttcaagccgagcgtcctgatcaacccgatcacgcggatgatcacgcagaaggagatcgagatggggatgagcggcaagagccagtacgtctacacggacagcctgaacgagggtacgatcggcttctcaggagcctacgggccatccggcatcgccaagttcacgtcggcagtcgcagtctcggtctcgaacgcgaccgcctcggagtacaagtccatcaaggtctcctacaacatcagcatgatctccggcatcgagtacatcgacttcgacaacctgaccgtcgaggacgtcctgaactccttgagcgctggacccaagaacctgagcctgaaggtgctcgacaagttcatcgccgctagagactgctcgggatctagcatcgagaaggaggagctgatgaaggagtgggtcaagagcctccagaacttcatcagctcttacggcgacggactggttgtcggagccatctggggaggcatgggcagcgtctctaccgagatgacctccaagaagacggaggactcgtggaagtacggcgagacggctgagttcagctactccggcatcgggagctccgtcagcatcgcgcagacgtacaacggctcccagaaggaccagagctccgaagtcgaggtcagctgcaaggcgcttgcctcaggaggctgcgtcgagtctcaggtgaactcgtggttcgacgtcgtggccaacaagtcgttcgccgagatcagcgggatctcactgctggacaaggctcccatgcagtcatccgtgtcaccacctccgaagatcccggacttcctcaagcccgagaagaacgcggagatcacggagaagctcgagacgatcaagaagctcggcgacagcgaggagttcgcactggcctcaggctacgaggaggcgaagaagacgaacccgaacctgacgttcgaggagttcaagtccaccgtccgcgacaagaacaacatcgacggcctcaacgagcttgcgtccaaggtgcaggagaactcgctggacgttctggcggaaggctcgatctccagacgcaacaagaacctctccctccaaggcgtcaggactatctcactcgagtcgtccagcgactacgcggtcctcggagcctggatcgccaactggagcgacatctttccctggatgtcgatgggctacatgaacgagatcagcgacgcggaggtggcggagtacatcctcaagatccggtgcatgatgcaggaccttagcacgctcaacacgatctacaacacgttcaacgcctgcaacatcaagctggacttctgccacctgaacagcgcgtcacaggtcgcggactcgttcaagatcgcccagggagtgctcagcgacaacgtcgagtcggacgacgcagtcgagatcgcgttcaactcgctcagcgacgaggccaagaagatctacacagcctggaacgagatcggcttcctgcgcaacgctgagctcggactgggactcctcatcggcgaccagagcgtgagctccgagatcatcgacgtcaagccgatcccgttcccagaggtcacctacaaggctgcgtactgcagctacggcaacaacaacccgaccgccttcagctccttcatcaagatgctccccttcatcgacacgaacggtgacatctacgcgttcggacccagcctcatgctccttcgcaaggcactcccggagaagatgatcttcaccaagggtggcgagatggcgatgaagctgaccgccgacaaggacaccggcatcctcacgaacgactccgtgaagttgatccccataccttacagcgccgctaagggcatccagtggagaggtcaagggcagggcagatcactcgccagcagccagtcactgcaagaccagtttgcagctctcgagaaggagctgggcaacctgaacatctgcaccctgtcgagcgactcctggagcaaggactggacgtacacagtcccgtacaccctgcgcaagatcagcactacctacatcgggaccgtggagaagatcaacagcatcttcggctga

SEQ ID NO: 301 - protein, 146 aa, Artificial Sequence
  AfIP-1A-31 variant
MTAKDIATEESKIRAYAQWIEITIFVVNSNFKVEGAYLRWGKFHVPGDFDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 302 - protein, 146 aa, Artificial Sequence
  AfIP-1A-31 variant
MTAKDIATEESKIRAYAQWIEITIFVVNSNFKVEGAYLRWGKFHVPGDLDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 303 - protein, 146 aa, Artificial Sequence
  AfIP-1A-31 variant
MTAKDIATEESKIRAYAQWIEITIFVVNSNFKVEGAYLRWGKFHVPGDKFKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 304 - protein, 146 aa, Artificial Sequence
  AfIP-1A-31 variant
MTAKDIATEESKIRAYAQWIEITIFVVNSNFKVEGAYLRWGKFHVPGDKLKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 305 - protein, 146 aa, Artificial Sequence
  AfIP-1A-31 variant
MTAKDIATEESKIRAYAQWIEITIFVVNSNFKVEGAYLRWGKFHVPGDKDFEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 306 - protein, 146 aa, Artificial Sequence
  AfIP-1A-31 variant
MTAKDIATEESKIRAYAQWIEITIFVVNSNFKVEGAYLRWGKFHVPGDKDLEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 307 - protein, 146 aa, Artificial Sequence
  AfIP-1A-31 variant
MTAKDIATEESKIRAYAQWIEITIFVVNSNFKVEGAYLRWGKFHVPGDKDKLISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 308 - protein, 146 aa, Artificial Sequence
  AfIP-1A-31 variant
MTAKDIATEESKIRAYAQWIEITIFVVNSNFKVEGAYLRWGKFHVPGDKDKEIFPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 309 - protein, 146 aa, Artificial Sequence
  AfIP-1A-31 variant
MTAKDIATEESKIRAYAQWIEITIFVVNSNFKVEGAYLRWGKFHVPGDKDKEILPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 310 - protein, 146 aa, Artificial Sequence
  AfIP-1A-31 variant
MTAKDIATEESKIRAYAQWIEITIFVVNSNFKVEGAYLRWGKFHVPGDKDKEISFSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 311 - protein, 146 aa, Artificial Sequence
  AfIP-1A-31 variant
MTAKDIATEESKIRAYAQWIEITIFVVNSNFKVEGAYLRWGKFHVPGDKDKEISLSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 312 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagatttcgacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 313 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagatttagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 314 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaattcaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 315 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaattaaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 316 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagactttgaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 317 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacttggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 318 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaagttgataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 319 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaatatttcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 320 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaatattgcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 321 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagttttagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 322 - DNA, 441 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtttgagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcctaa

SEQ ID NO: 323 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKETEDSWKYGETAEFSYSGIGSSVSIAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPLPYPEVTYRAAYCSYGNNNPTAFSSFIKMLPFIDTNGDIYAFGPSLMLLRKALPEKMIFTKGGEMAMKLTAGKDTGILTNDSVKLIPIPYSAAKGIQWRGQGQGRSLASSQSLQDQFAALEKELGNLNICTLSSDSWSKDWTYTVPYTLRKISTTYIGTVEKINSISG

SEQ ID NO: 324 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDAKPLPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 325 - protein, 703 aa, Artificial Sequence
  AfIP-1B-32 variant
MDIEAKSINPLMGITVGSTVLGNDFKPSVLINPITRMLTQKEIEMGMSGKSQFVYTDSLNEGTIGFSGAYGPSGIAKFTSAVAVSVSNATASEFKSIKVSYNLSMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 326 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNLSMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYVLKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 327 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 328 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 329 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 330 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKFGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 331 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPLPFPEVTYKAAFCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 332 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAFCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 333 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSLSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 334 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSLAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 335 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSFNLSMLSGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 336 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMLSGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTFKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 337 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNLSMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGVWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 338 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 339 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSLAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPLPYPEVTYKAAFCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 340 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEFKSIKVSFNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGLGSSVSLAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 341 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSLAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAVYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAFCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 342 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSLKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 343 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSFNLSMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 344 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSFNISMLSGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEDSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTALSSFIKMLPFIDTNGDIYAFGPSLMLLRKALPEKMIFTKGGEMAMKLTADKDTGILTNDSVKLIPIPYSAAKGIQFRGQGQGRSLASSQSLQDQFAALEKELGNLNICTLSSDSWSKDWTYTVPYTLRKISTTYIGTVEKINSIFG

SEQ ID NO: 345 - protein, 703 aa, Artificial Sequence
  AfIP-1B-32 variant
MDIEAKSINPLMGITVGSTVLGNDFKPSVLINPITRMITQKEIEMGMSGKSQFVYTDSLNEGTIGFSGAYGPSGIAKFTSAVAVSVSNATASEFKSIKVSFNISMISGLEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEENAEITEKLDTIKKLGDSEEFALASGYEEAKKTNPNLTFEEFKSTVRDKNNIDGLNELASKVQENSLDVLAKGSISRRNKNLSLQGVRTISLDSSSDYAVLGAWIANWSDIFPWMSMGYMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 346 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMLSGIEYIDFDNLTVEDVLNSLSAGPKNLSLKVLEKFIAARDCSGSSIEKDELMKEWVKSLQNFISSYGDGLVVGAIWGGMGSLSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMTQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 347 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSFKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTFKAAYCSFGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 348 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEVAMKLTADKDTGIPTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 349 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNLSMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAFCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 350 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSFNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 351 - protein, 703 aa, Artificial Sequence
  AfIP-1B-32 variant
MDIEAKSINPLMGITVGSTVLGNDFKPSVLINPITRMITQKEIEMGMSGKSQYVFTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKFGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 352 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSLKVSFNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSLAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 353 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAYCSFGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSRSLQDQFAALEKELGNLNICTLSSDSWSKDWTYTVPYTLRKISTTYIGTVEKINSIFG

SEQ ID NO: 354 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQFRGQGQGRSLASSQSLQDQFAALEKELGNLNICTLSSDSWSKDWTYTVPYTLRKISTTYIGTVEKINSIFG

SEQ ID NO: 355 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNLSMISGIEYIDFDNLTVEDVLNSLSAGPKNLLLKVLEKFIAARDCSGSSIEKDELMKEWVKSLQNFISSYGDGLVVGAIWGGMGSLSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTFKAAYCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 356 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSLAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGTLTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 357 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEFKSIKVSFNISMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPLPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 358 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSFNISMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTFKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 359 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQFRGQGQGRSLASSQSLQDQFAALEKELGNLNICTLSSDSWSKDWTYTVPYTLRKISTTYIGTVEKINSIFG

SEQ ID NO: 360 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSLSTEMTSKKTEDSWKYGETAEFSYSGLGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTFKAAFCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 361 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 362 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSLSTEMTSKKTEDSWKYGETAEFSYSGIGSSVSIAQTFNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRSAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 363 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTFNGSQKDQSSEVEVSCKALASGGCVESQVNSWFDVVANKSFAEISGVSLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAFCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 364 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGLEYIDFDNLTVEDVLNSLSAGPKNLSLKVLEKFIAARDCSGSSIEKDELMKEWVKSLQNFISSYGDGLVVGALWGGMGSVSTEMTSKKTEDSWKFGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 365 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSLAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTFKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 366 - protein, 703 aa, Artificial Sequence
  AfIP-1B-32 variant
MDIEAKSINPLMGITVGSTVLGNDFKPSVLINPITRMITQKEIEMGMSGKSQFVYTDSLNEGTIGFSGAYGPSGIAKFTSAVAVSVSNATASEYKSIKVSYNLSMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 367 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGLEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 368 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGLEYIDFDNLTVEDVLNSLSAGPKNLSLKVLEKFIAARDCSGSSIEKDELMKEWVKSLQNFISSYGDGLVVGAIWGGMGSLSTEMTSKKTEDSWKYGETAEFSYSGIGSSVSIAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAFCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 369 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNLSMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPFPEVTFKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 370 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSLSSEIIDVKPIPYPEVTYKAAYCSYGNNNPTAFSSFIKMLPFIDTNGDIYAFGPSLMLLRKALPEKMIFTKGGEMAMKLTADKDTGILTDDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 371 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGLGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPFPEVTYKAAYCSYGNNNPTAFSSFIKVLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 372 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINGIFG

SEQ ID NO: 373 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 374 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTFKAAYCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 375 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGALWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGLQWRGQGQGRSLASSQSLQDQFAALEKELGNLNICTLSSDSWSKDWTYTVPYTLRKISTTYIGTVEKINSIFG

SEQ ID NO: 376 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSLSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGSLNICTLSSDSWSKDWTYTVPYTLRKISTTYIGTVEKINSIFG

SEQ ID NO: 377 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 378 - protein, 703 aa, Artificial Sequence
  AfIP-1B-32 variant
MDIEAKSINPLMGITVGSTVLGNDFKPSVLINPITRMITQKEIEMGMSGKSQYVFTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQFRGQGQGRSLASSQSLQDQFAALEKELGNLNICTLSSDSWSKDWTYTVPYTLRKISTTYIGTVEKINSIFG

SEQ ID NO: 379 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 380 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRSNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 381 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTFKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 382 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSFGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 383 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGLGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 384 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNELSDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 385 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAFCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 386 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMLSGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSELEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 387 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSFKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 388 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTFNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPFPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 389 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGFMNEISDAELAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSELIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 390 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRNAELGLGLLIGDQSVSSEIIDVKPLPYPEVTYKAAFCSYGNNNPTAFSSFIKMLPFIDTNGDIYAFGPSLMLLRKALPEKMIFTKGGEMAMKLTADKDTGILTNDSVKLIPIPFSAAKGIQWRGQGQGRSLASSQSLQDQFAALEKELGNLNICTLSSDSWSKDWTYTVPYTLRKISTTYIGTVEKINSIFG

SEQ ID NO: 391 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaagaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgctaccgtatcccgaggtcacctacagggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctggtaaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatctgga

SEQ ID NO: 392 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgctaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattttgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 393 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgcttacccaaaaagaaattgaaatgggtatgagtggtaaaagccaatttgtctacactgactccttgaacgagggaaccattggcttttcaggagcctatggtccctcggggatcgccaagtttacctctgcagttgctgtatccgtcagcaatgccactgcttcggagttcaagtctataaaagtctcctacaatctttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 394 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacgtcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 395 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 396 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 397 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 398 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtttggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 399 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgctaccgtttcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 400 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 401 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccctcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 402 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccctagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgataccgtttcccgaggtcacctacaaggcagcctattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 403 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctccttcaatctttccatgctctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgagagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgaccgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 404 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgctctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcaccttcaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 405 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgagagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgtctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 406 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaagataagcactacctatatcggaaccgttgagaaaatcaacagtatatttgga

SEQ ID NO: 407 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccctagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgctaccgtatcccgaggtcacctacaaggcagctttttgcagctatggaaacaacaacccgactgcttttagctcgttcataaagatgcttccattcattgatacgaatggtgatatttatgccttcgggccatccctgatgctattgcgaaaggctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 408 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagttcaagtctataaaagtctccttcaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggctaggaagttccgtatccctagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 409 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccctagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggtgtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagctttttgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacttatatcggaaccgttgagaaaatcaacagtatatttgga

SEQ ID NO: 410 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctctaaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 411 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctccttcaatctttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 412 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctccttcaatatttccatgctctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaagacagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgctcttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatttcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 413 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatttgtctacactgactccttgaacgagggaaccattggcttttcaggagcctatggtccctcggggatcgccaagtttacctctgcagttgctgtatccgtcagcaatgcaactgcttcggagttcaagtctataaaagtctccttcaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaagaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcaaaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 414 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgctctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgacgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 415 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcaccttcaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 416 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgctcccattcattgatacgaatggtgatatttatgccttcgggccatccctgatgctattgcgaaaagctttgcctgaaaaaatgattttcaccaaaggcggagaagtggcaatgaagctaacggctgataaagacacagggattccgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 417 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 418 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctccttcaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 419 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtcttcactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtttggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgccgagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 420 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctctaaaagtctccttcaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccctagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgataccgtatcccgaggtcacctacaaggcagcttattgcagctatggaaacaacaacccgactgcttttagctcgttcataaagatgctcccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 421 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccgatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 422 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatttcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 423 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggaatagaatatatcgactttgacaatctgacggtagaggacgtattaaactctttaagtgcaggacctaaaaatcttttgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcaccttcaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 424 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccctagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggactctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 425 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagttcaagtctataaaagtctccttcaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgctaccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 426 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctccttcaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcaccttcaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 427 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagcaaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatttcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 428 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggctaggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcaccttcaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 429 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 430 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggataggaagttccgtatccatagcgcaaacctttaatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcagcgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 431 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggagttagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 432 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtttggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 433 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccctagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcaccttcaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 434 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatttgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 435 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 436 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggactagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 437 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatctttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtttcccgaggtcaccttcaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 438 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcactaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactgacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 439 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtttcccgaggtcacctacaaggcagcttattgcagctatggaaacaacaacccgactgcttttagctcgttcataaaggtgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 440 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacggtatatttgga

SEQ ID NO: 441 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 442 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcaccttcaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 443 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccctctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcctgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggacttcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 444 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctctttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcagtctcaacatttgcaccttaagcagcgattcctggtctaaggattggacttataccgttccctacaccctgagaaaaataagcactacctatatcggaaccgttgagaaaatcaacagtatatttgga

SEQ ID NO: 445 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagcgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 446 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtcttcactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaagtctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatttcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 447 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 448 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaagtaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 449 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcaccttcaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 450 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctttggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 451 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggctaggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 452 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcagtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaactcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 453 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 454 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgctctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaacttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 455 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctttaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 456 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctttaatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtttcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 457 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggattcatgaacgaaatcagtgatgctgagcttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaacttatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 458 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggcctgctcattggggatcagtcagtaagcagtgaaattatcgacgttaagccgctaccgtatcccgaggtcacctacaaggcagctttttgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccattctctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 459 - DNA, 37 bp, Artificial Sequence
  mutagenesis primer
cagttctgataaatccacttaccagaatgattaccca

SEQ ID NO: 460 - DNA, 36 bp, Artificial Sequence
  mutagenesis primer
atccaattaccagaatgcttacccaaaaagaaattg

SEQ ID NO: 461 - DNA, 37 bp, Artificial Sequence
  mutagenesis primer
gaatgattacccaaaaagaacttgaaatgggtatgag

SEQ ID NO: 462 - DNA, 37 bp, Artificial Sequence
  mutagenesis primer
gagtggtaaaagccaatttgtctacactgactccttg

SEQ ID NO: 463 - DNA, 37 bp, Artificial Sequence
  mutagenesis primer
ggtaaaagccaatatgtcttcactgactccttgaacg

SEQ ID NO: 464 - DNA, 37 bp, Artificial Sequence
  mutagenesis primer
ctgcagttgctgtatccctcagcaatgcaactgcttc

SEQ ID NO: 465 - DNA, 37 bp, Artificial Sequence
  mutagenesis primer
tgcaactgcttcggagttcaagtctataaaagtctcc

SEQ ID NO: 466 - DNA, 37 bp, Artificial Sequence
  mutagenesis primer
cttcggagtacaagtctctaaaagtctcctacaatat

SEQ ID NO: 467 - DNA, 38 bp, Artificial Sequence
  mutagenesis primer
ctataaaagtctccttcaatatttccatgatctcggga

SEQ ID NO: 468 - DNA, 38 bp, Artificial Sequence
  mutagenesis primer
gtctcctacaatctttccatgatctcgggaatagaata

SEQ ID NO: 469 - DNA, 37 bp, Artificial Sequence
  mutagenesis primer
ctcctacaatatttccatgctctcgggaatagaatat

SEQ ID NO: 470 - DNA, 39 bp, Artificial Sequence
  mutagenesis primer
atttccatgatctcgggactagaatatatcgactttgac

SEQ ID NO: 471 - DNA, 37 bp, Artificial Sequence
  mutagenesis primer
gtctggtcgtgggagccctctggggtggaatgggctc

SEQ ID NO: 472 - DNA, 36 bp, Artificial Sequence
  mutagenesis primer
ggtggaatgggctctctttctacggagatgacgagc

SEQ ID NO: 473 - DNA, 40 bp, Artificial Sequence
  mutagenesis primer
aaaacagaagacagctttaagtatggagaaacggctgaat

SEQ ID NO: 474 - DNA, 39 bp, Artificial Sequence
  mutagenesis primer
acagaagacagctggaagtttggagaaacggctgaattc

SEQ ID NO: 475 - DNA, 36 bp, Artificial Sequence
  mutagenesis primer
gaattcagctattcagggctaggaagttccgtatcc

SEQ ID NO: 476 - DNA, 39 bp, Artificial Sequence
  mutagenesis primer
gataggaagttccgtatccctagcgcaaacctataatgg

SEQ ID NO: 477 - DNA, 38 bp, Artificial Sequence
  mutagenesis primer
cgtatccatagcgcaaacctttaatggatctcaaaaag

SEQ ID NO: 478 - DNA, 37 bp, Artificial Sequence
  mutagenesis primer
gatcaaagctctgaacttgaggtatcttgcaaggctc

SEQ ID NO: 479 - DNA, 39 bp, Artificial Sequence
  mutagenesis primer
atggatgtcgatgggattcatgaacgaaatcagtgatgc

SEQ ID NO: 480 - DNA, 39 bp, Artificial Sequence
  mutagenesis primer
gatgggatacatgaacgaactcagtgatgctgaggttgc

SEQ ID NO: 481 - DNA, 36 bp, Artificial Sequence
  mutagenesis primer
gaaatcagtgatgctgagcttgcggagtacatcctg

SEQ ID NO: 482 - DNA, 36 bp, Artificial Sequence
  mutagenesis primer
ctcattggggatcagtcactaagcagtgaaattatc

SEQ ID NO: 483 - DNA, 34 bp, Artificial Sequence
  mutagenesis primer
gtcagtaagcagtgaacttatcgacgttaagccg

SEQ ID NO: 484 - DNA, 35 bp, Artificial Sequence
  mutagenesis primer
atcgacgttaagccgctaccgtatcccgaggtcac

SEQ ID NO: 485 - DNA, 37 bp, Artificial Sequence
  mutagenesis primer
ttaagccgataccgtttcccgaggtcacctacaaggc

SEQ ID NO: 486 - DNA, 36 bp, Artificial Sequence
  mutagenesis primer
tatcccgaggtcaccttcaaggcagcttattgcagc

SEQ ID NO: 487 - DNA, 38 bp, Artificial Sequence
  mutagenesis primer
tcacctacaaggcagctttttgcagctatggaaacaac

SEQ ID NO: 488 - DNA, 37 bp, Artificial Sequence
  mutagenesis primer
aggcagcttattgcagctttggaaacaacaacccgac

SEQ ID NO: 489 - DNA, 37 bp, Artificial Sequence
  mutagenesis primer
gttgatacctattccattctctgccgccaagggaatt

SEQ ID NO: 490 - DNA, 37 bp, Artificial Sequence
  mutagenesis primer
ctgccgccaagggacttcaatggcgggggcaaggcca

SEQ ID NO: 491 - DNA, 37 bp, Artificial Sequence
  mutagenesis primer
cgccaagggaattcaatttcgggggcaaggccaaggt

SEQ ID NO: 492 - DNA, 38 bp, Artificial Sequence
  mutagenesis primer
  misc_feature (18)..(18): w is a or t
  misc_feature (24)..(24): w is a or t
gagtggtaaaagccaatwtgtctwcactgactccttga

SEQ ID NO: 493 - DNA, 45 bp, Artificial Sequence
  mutagenesis primer
  misc_feature (11)..(11): w is a or t
  misc_feature (19)..(19): m is a or c
  misc_feature (32)..(32): w is a or t
  misc_feature (37)..(37): m is a or c
gcttcggagtwcaagtctmtaaaagtctcctwcaatmtttccatg

SEQ ID NO: 494 - DNA, 47 bp, Artificial Sequence
  mutagenesis primer
  misc_feature (12)..(12): w is a or t
  misc_feature (17)..(17): m is a or c
  misc_feature (26)..(26): m is a or c
  misc_feature (35)..(35): m is a or c
aaaagtctcctwcaatmtttccatgmtctcgggamtagaatatatcg

SEQ ID NO: 495 - DNA, 36 bp, Artificial Sequence
  mutagenesis primer
  misc_feature (21)..(21): w is a or t
aacagaagacagctttaagtwtggagaaacggctga

SEQ ID NO: 496 - DNA, 38 bp, Artificial Sequence
  mutagenesis primer
  misc_feature (12)..(12): m ia a or c
  misc_feature (25)..(25): w is a or t
gttccgtatccmtagcgcaaacctwtaatggatctcaa

SEQ ID NO: 497 - DNA, 34 bp, Artificial Sequence
  mutagenesis primer
  misc_feature (13)..(13): m is a or c
ttcatgaacgaamtcagtgatgctgagcttgcgg

SEQ ID NO: 498 - DNA, 37 bp, Artificial Sequence
  mutagenesis primer
  misc_feature (10)..(10): s is g or c
  misc_feature (22)..(22): m is a or c
gatcagtcastaagcagtgaamttatcgacgttaagc

SEQ ID NO: 499 - DNA, 36 bp, Artificial Sequence
  mutagenesis primer
  misc_feature (16)..(16): m is a or c
  misc_feature (23)..(23): w is a or t
atcgacgttaagccgmtaccgtwtcccgaggtcacc

SEQ ID NO: 500 - DNA, 44 bp, Artificial Sequence
  mutagenesis primer
  misc_feature (12)..(12): w is a or t
  misc_feature (24)..(24): w is a or t
  misc_feature (33)..(33): w is a or t
cgaggtcacctwcaaggcagcttwttgcagctwtggaaacaaca

SEQ ID NO: 501 - DNA, 41 bp, Artificial Sequence
  mutagenesis primer
  misc_feature (9)..(9): w is a or t
  misc_feature (21)..(21): w is a or t
  misc_feature (30)..(30): w is a or t
ggtcacctwcaaggcagcttwttgcagctwtggaaacaaca

SEQ ID NO: 502 - protein, 146 aa, Artificial Sequence
  AfIP-1A-31 variant
MTAKDIATEESKIRAYAQWIEITIFVVNSNFKVEGAYLRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 503 - protein, 146 aa, Artificial Sequence
  AfIP-1A-31 variant
MTAKDIATEESKIRAYAQWIEITIFVVNSNFKVEGAYLKWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 504 - protein, 146 aa, Artificial Sequence
  AfIP-1A-31 variant
MTAKDIATEESKIRAYAQWIEITIFVVNSNFKVEGAYVRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 505 - protein, 146 aa, Artificial Sequence
  AfIP-1A-31 variant
MTAKDIATEESKIRAYAQWIEITIFVVNSNFKVEGAYMKWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 506 - protein, 146 aa, Artificial Sequence
  AfIP-1A-31 variant
MTAKDIATEESKIRAYAQWIEITIFVVNSNFKVEGAYMRWGKFHMAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 507 - protein, 146 aa, Artificial Sequence
  AfIP-1A-31 variant
MTAKDIATEESKIRAYAQWIEITIFVVNSNFKVEGAYVRWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 508 - protein, 146 aa, Artificial Sequence
  AfIP-1A-31 variant
MTAKDIATEESKIRAYAQWIEITIFVVNSNFKVEGSYLRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 509 - protein, 146 aa, Artificial Sequence
  AfIP-1A-31 variant
MTAKDIATEESKIRAYAQWIEITIFVVNSNFKVEGSYVRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 510 - protein, 146 aa, Artificial Sequence
  AfIP-1A-31 variant
MTAKDIATEESKIRAYAQWIEITIFVVNSNFKVEGAYVRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 511 - protein, 146 aa, Artificial Sequence
  AfIP-1A-31 variant
MTAKDIATEESKIRAYAQWIEITIFVVNSNFKVEGAYMRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 512 - protein, 146 aa, Artificial Sequence
  AfIP-1A-31 variant
MTAKDIATEESKIRAYAQWIEITIFVVNSNFKVEGSYMRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 513 - protein, 146 aa, Artificial Sequence
  AfIP-1A-31 variant
MTAKDIATEESKIRAYAQWIEITIFVVNSNFKVEGSYVRWGKFHIPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 514 - protein, 146 aa, Artificial Sequence
  AfIP-1A-31 variant
MTAKDIATEESKIRAYAQWIEITIFVVNSNFKVEGTFLKWGKFHMAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 515 - protein, 146 aa, Artificial Sequence
  AfIP-1A-31 variant
MTAKDIATEESKIRAYAQWIEITIFVVNSNFKVEGSYLKWGKFHMPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 516 - protein, 146 aa, Artificial Sequence
  AfIP-1A-31 variant
MTAKDIATEESKIRAYAQWIEITIFVVNSNFKVEGSYLKWGKFHMAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 517 - protein, 146 aa, Artificial Sequence
  AfIP-1A-31 variant
MTAKDIATEESKIRAYAQWIEITIFVVNSNFKVEGTFLKWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 518 - protein, 146 aa, Artificial Sequence
  AfIP-1A-31 variant
MTAKDIATEESKIRAYAQWIEITIFVVNSNFKVEGTFIKWGKFHIPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 519 - protein, 146 aa, Artificial Sequence
  AfIP-1A-31 variant
MTAKDIATEESKIRAYAQWIEITIFVVNSNFKVEGSFMKWGKFHIPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 520 - protein, 146 aa, Artificial Sequence
  AfIP-1A-31 variant
MTAKDIATEESKIRAYAQWIEITIFVVNSNFKVEGSFVKWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 521 - protein, 146 aa, Artificial Sequence
  AfIP-1A-31 variant
MTAKDIATEESKIRAYAQWIEITIFVVNSNFKVEGSFVKWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 522 - protein, 146 aa, Artificial Sequence
  AfIP-1A-31 variant
MTAKDIATEESKIRAYAQWIEITIFVVNSNFKVEGAFVKWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 523 - protein, 146 aa, Artificial Sequence
  AfIP-1A-31 variant
MTAKDIATEESKIRAYAQWIEITIFVVNSNFKVEGAFVKWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 524 - protein, 146 aa, Artificial Sequence
  AfIP-1A-31 variant
MTAKDIATEESKIRAYAQWIEITIFVVNSNFKVEGAFVKWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 525 - protein, 146 aa, Artificial Sequence
  AfIP-1A-31 variant
MTAKDIATEESKIRAYAQWIEITIFVVNSNFKVEGTFVKWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 526 - protein, 146 aa, Artificial Sequence
  AfIP-1A-31 variant
MTAKDIATEESKIRAYAQWIEITIFVVNSNFKVEGTYVKWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 527 - protein, 146 aa, Artificial Sequence
  AfIP-1A-31 variant
MTAKDIATEESKIRAYAQWIEITIFVVNSNFKVEGSFVRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 528 - protein, 146 aa, Artificial Sequence
  AfIP-1A-31 variant
MTAKDIATEESKIRAYAQWIEITIFVVNSNFKVEGSFVRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 529 - protein, 146 aa, Artificial Sequence
  AfIP-1A-31 variant
MTAKDIATEESKIRAYAQWIEITIFVVNSNFKVEGSFLRWGKFHMAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 530 - protein, 146 aa, Artificial Sequence
  AfIP-1A-31 variant
MTAKDIATEESKIRAYAQWIEITIFVVNSNFKVEGSFLRWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 531 - protein, 146 aa, Artificial Sequence
  AfIP-1A-31 variant
MTAKDIATEESKIRAYAQWIEITIFVVNSNFKVEGSFIRWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 532 - protein, 146 aa, Artificial Sequence
  AfIP-1A-31 variant
MTAKDIATEESKIRAYAQWIEITIFVVNSNFKVEGAFLRWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 533 - protein, 146 aa, Artificial Sequence
  AfIP-1A-31 variant
MTAKDIATEESKIRAYAQWIEITIFVVNSNFKVEGAFLRWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 534 - protein, 146 aa, Artificial Sequence
  AfIP-1A-31 variant
MTAKDIATEESKIRAYAQWIEITIFVVNSNFKVEGTYLRWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 535 - protein, 146 aa, Artificial Sequence
  AfIP-1A-31 variant
MTAKDIATEESKIRAYAQWIEITIFVVNSNFKVEGTFMRWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 536 - protein, 146 aa, Artificial Sequence
  AfIP-1A-31 variant
MTAKDIATEESKIRAYAQWIEITIFVVNSNFKVEGAFMRWGKFHLPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 537 - protein, 146 aa, Artificial Sequence
  AfIP-1A-31 variant
MTAKDIATEESKIRAYAQWIEITIFVVNSNFKVEGTFVRWGKFHLAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 538 - protein, 146 aa, Artificial Sequence
  AfIP-1A-31 variant
MTAKDIATEESKIRAYAQWIEITIFVVNSNFKVEGAFIRWGKFHIPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 539 - protein, 146 aa, Artificial Sequence
  AfIP-1A-31 variant
MTAKDIATEESKIRAYAQWIEITIFVVNSNFKVEGAFVRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 540 - protein, 146 aa, Artificial Sequence
  AfIP-1A-31 variant
MTAKDIATEESKIRAYAQWIEITIFVVNSNFKVEGAFVRWGKFHMPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 541 - protein, 146 aa, Artificial Sequence
  AfIP-1A-31 variant
MTAKDIATEESKIRAYAQWIEITIFVVNSNFKVEGAFIRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 542 - protein, 146 aa, Artificial Sequence
  AfIP-1A-31 variant
MTAKDIATEESKIRAYAQWIEITIFVVNSNFKVEGTFIRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 543 - protein, 146 aa, Artificial Sequence
  AfIP-1A-31 variant
MTAKDIATEESKIRAYAQWIEITIFVVNSNFKVEGTFIRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 544 - protein, 146 aa, Artificial Sequence
  AfIP-1A-31 variant
MTAKDIATEESKIRAYAQWIEITIFVVNSNFKVEGAFVRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 545 - protein, 146 aa, Artificial Sequence
  AfIP-1A-31 variant
MTAKDIATEESKIRAYAQWIEITIFVVNSNFKVEGAFLRWGKFHVAGDKDKEISPSQINGTIIKDEDSYTIASCGRENASSGTEGGFSLYDGDKLVFEYYWDCPWSGSNSDELTVKDKENYTVIKKGGGSPSGATGNIFITVVKKS

SEQ ID NO: 546 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacctcaggtggggaaagttccatgtcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 547 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacctgaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 548 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtcaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 549 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacatgaagtggggaaagttccatctcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 550 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacatgaggtggggaaagttccatatggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 551 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtcaggtggggaaagttccatctggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 552 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacctgaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 553 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacgtgaggtggggaaagttccatgtcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 554 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 555 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacatgaggtggggaaagttccatgtccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 556 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacatgaggtggggaaagttccatgtccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 557 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacgtgaggtggggaaagttccatatccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 558 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcctgaagtggggaaagttccatatggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 559 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacctcaagtggggaaagttccatatgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 560 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacctgaagtggggaaagttccatatggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 561 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcctgaagtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 562 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcatcaagtggggaaagttccatatccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 563 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcatgaagtggggaaagttccatatccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 564 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcgtgaagtggggaaagttccatgtccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 565 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcgtcaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 566 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtcaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 567 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtgaagtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 568 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtcaagtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 569 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcgtgaagtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 570 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgtacgtgaagtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 571 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcgtcaggtggggaaagttccatgtcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 572 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 573 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcctcaggtggggaaagttccatatggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 574 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcctgaggtggggaaagttccatctggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 575 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcatcaggtggggaaagttccatctggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 576 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcctgaggtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 577 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcctgaggtggggaaagttccatctggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 578 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgtacctgaggtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 579 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcatgaggtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 580 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcatgaggtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 581 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcgtgaggtggggaaagttccatctggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 582 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcatcaggtggggaaagttccatatccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 583 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 584 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtgaggtggggaaagttccatatgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 585 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcatcaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 586 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcatcaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 587 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcatcaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 588 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtcaggtggggaaagttccatgtcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 589 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcctgaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaagtggcgcgacaggcaatatcttcattactgttgtcaaaaaatcc

SEQ ID NO: 590 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGSTGEIFITVVKKS

SEQ ID NO: 591 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGATGEIFITVVKKS

SEQ ID NO: 592 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSSTSGEMFITVVKKS

SEQ ID NO: 593 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGAAGEVYITVVKKS

SEQ ID NO: 594 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSATAGEVYITVVKKS

SEQ ID NO: 595 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTSAAGNVFITVVKKS

SEQ ID NO: 596 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGASGDVYITVVKKS

SEQ ID NO: 597 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGSAGNLFITVVKKS

SEQ ID NO: 598 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGSAGKLFITVVKKS

SEQ ID NO: 599 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGTSGNLFITVVKKS

SEQ ID NO: 600 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGASGNLFITVVKKS

SEQ ID NO: 601 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGSTGNLYITVVKKS

SEQ ID NO: 602 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGSAGNLYITVVKKS

SEQ ID NO: 603 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGSSGELFITVVKKS

SEQ ID NO: 604 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGSTGKMYITVVKKS

SEQ ID NO: 605 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGATGKVFITVVKKS

SEQ ID NO: 606 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGSTGEVFITVVKKS

SEQ ID NO: 607 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGATGNLFITVVKKS

SEQ ID NO: 608 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTSTTGKLYITVVKKS

SEQ ID NO: 609 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGAAGDIFITVVKKS

SEQ ID NO: 610 - protein, 146 aa, Artificial Sequence; identical to SEQ ID NO: 604
  AfIP-1A-31 variant

SEQ ID NO: 611 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGAAGDMYITVVKKS

SEQ ID NO: 612 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGASGNVYITVVKKS

SEQ ID NO: 613 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGSTGELFITVVKKS

SEQ ID NO: 614 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGSSGKMFITVVKKS

SEQ ID NO: 615 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPAGSTGDIYITVVKKS

SEQ ID NO: 616 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPSGATGDIFITVVKKS

SEQ ID NO: 617 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTSSAGNMYITVVKKS

SEQ ID NO: 618 - protein, 146 aa, Artificial Sequence
  AfIP-1A-31 variant
MTAKDIATEESKIRAYAQWIEITIFVVNSNFKVEGAYLRWGKFHVPGDKDKEISPSQINGTIIKDEDSYTIASCGRENASSGTEGGFSLYDGDKLVFEYYWDCPWSGSNSDELTVKDKENYTVIKKGGGSPTGTAGDIYITVVKKS

SEQ ID NO: 619 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcgacgggcgaaatcttcattactgttgtcaaaaaatcc

SEQ ID NO: 620 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgggggcgacgggcgaaatcttcattactgttgtcaaaaaatcc

SEQ ID NO: 621 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgtcgacgtcgggcgaaatgttcattactgttgtcaaaaaatcc

SEQ ID NO: 622 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcggcgggcgaagtgtacattactgttgtcaaaaaatcc

SEQ ID NO: 623 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggcgacggcgggcgaagtctacattactgttgtcaaaaaatcc

SEQ ID NO: 624 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgtcggcggcgggcaatgtcttcattactgttgtcaaaaaatcc

SEQ ID NO: 625 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgggggcgtcgggcgatgtgtacattactgttgtcaaaaaatcc

SEQ ID NO: 626 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggggtcggcgggcaatctgttcattactgttgtcaaaaaatcc

SEQ ID NO: 627 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggggtcggcgggcaaactgttcattactgttgtcaaaaaatcc

SEQ ID NO: 628 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggacgtcgggcaatctcttcattactgttgtcaaaaaatcc

SEQ ID NO: 629 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcgggggcgtcgggcaatctcttcattactgttgtcaaaaaatcc

SEQ ID NO: 630 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggtcgacgggcaatctgtacattactgttgtcaaaaaatcc

SEQ ID NO: 631 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggtcggcgggcaatctctacattactgttgtcaaaaaatcc

SEQ ID NO: 632 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcgtcgggcgaactcttcattactgttgtcaaaaaatcc

SEQ ID NO: 633 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcgacgggcaaaatgtacattactgttgtcaaaaaatcc

SEQ ID NO: 634 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcgggggcgacgggcaaagtcttcattactgttgtcaaaaaatcc

SEQ ID NO: 635 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggggtcgacgggcgaagtcttcattactgttgtcaaaaaatcc

SEQ ID NO: 636 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgggggcgacgggcaatctgttcattactgttgtcaaaaaatcc

SEQ ID NO: 637 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgtcgacgacgggcaaactctacattactgttgtcaaaaaatcc

SEQ ID NO: 638 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcggcgggcgatatcttcattactgttgtcaaaaaatcc

SEQ ID NO: 639 - DNA, 438 bp, Artificial Sequence; identical to SEQ ID NO: 633
  AfIP-1A-31 variant

SEQ ID NO: 640 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcggcgggcgatatgtacattactgttgtcaaaaaatcc

SEQ ID NO: 641 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcgtcgggcaatgtctacattactgttgtcaaaaaatcc

SEQ ID NO: 642 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggtcgacgggcgaactgttcattactgttgtcaaaaaatcc

SEQ ID NO: 643 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggtcgtcgggcaaaatgttcattactgttgtcaaaaaatcc

SEQ ID NO: 644 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcggggtcgacgggcgatatctacattactgttgtcaaaaaatcc

SEQ ID NO: 645 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcgacgggcgatatcttcattactgttgtcaaaaaatcc

SEQ ID NO: 646 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgtcgtcggcgggcaatatgtacattactgttgtcaaaaaatcc

SEQ ID NO: 647 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatgtgccaggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggacggcgggcgatatctacattactgttgtcaaaaaatcc

SEQ ID NO: 648 - protein, 146 aa, Artificial Sequence
  AfIP-1A-31 variant
MTAKDIATEESKIRAYAQWIEITIFVVNSNFKVEGAYVRWGKFHVPGDKDKEISPSQINGTIIKDEDSYTIASCGRENASSGTEGGFSLYDGDKLVFEYYWDCPWSGSNSDELTVKDKENYTVIKKGGGSPTGSTGNLFITVVKKS

SEQ ID NO: 649 - protein, 146 aa, Artificial Sequence
  AfIP-1A-31 variant
MTAKDIATEESKIRAYAQWIEITIFVVNSNFKVEGAYVRWGKFHVPGDKDKEISPSQINGTIIKDEDSYTIASCGRENASSGTEGGFSLYDGDKLVFEYYWDCPWSGSNSDELTVKDKENYTVIKKGGGSPSSTTGKVFITVVKKS

SEQ ID NO: 650 - protein, 146 aa, Artificial Sequence
  AfIP-1A-31 variant
MTAKDIATEESKIRAYAQWIEITIFVVNSNFKVEGAFMRWGKFHLAGDKDKEISPSQINGTIIKDEDSYTIASCGRENASSGTEGGFSLYDGDKLVFEYYWDCPWSGSNSDELTVKDKENYTVIKKGGGSPSGSSGNIFITVVKKS

SEQ ID NO: 651 - protein, 146 aa, Artificial Sequence
  AfIP-1A-31 variant
MTAKDIATEESKIRAYAQWIEITIFVVNSNFKVEGAYLRWGKFHLAGDKDKEISPSQINGTIIKDEDSYTIASCGRENASSGTEGGFSLYDGDKLVFEYYWDCPWSGSNSDELTVKDKENYTVIKKGGGSPSWTSGKVYITVVKKS

SEQ ID NO: 652 - protein, 146 aa, Artificial Sequence
  AfIP-1A-31 variant
MTAKDIATEESKIRAYAQWIEITIFVVNSNFKVEGAFVKWGKFHVAGDKDKEISPSQINGTIIKDEDSYTIASCGRENASSGTEGGFSLYDGDKLVFEYYWDCPWSGSNSDELTVKDKENYTVIKKGGGSPTAATGNIYITVVKKS

SEQ ID NO: 653 - protein, 146 aa, Artificial Sequence
  AfIP-1A-31 variant
MTAKDIATEESKIRAYAQWIEITIFVVNSNFKVEGTFVRWGKFHVPGDKDKEISPSQINGTIIKDEDSYTIASCGRENASSGTEGGFSLYDGDKLVFEYYWDCPWSGSNSDELTVKDKENYTVIKKGGGSPASTTGEVFITVVKKS

SEQ ID NO: 654 - protein, 146 aa, Artificial Sequence
  AfIP-1A-31 variant
MTAKDIATEESKIRAYAQWIEITIFVVNSNFKVEGAYLKWGKFHVPGDKDKEISPSQINGTIIKDEDSYTIASCGRENASSGTEGGFSLYDGDKLVFEYYWDCPWSGSNSDELTVKDKENYTVIKKGGGSPSWATGNLYITVVKKS

SEQ ID NO: 655 - protein, 146 aa, Artificial Sequence
  AfIP-1A-31 variant
MTAKDIATEESKIRAYAQWIEITIFVVNSNFKVEGSFLRWGKFHVPGDKDKEISPSQINGTIIKDEDSYTIASCGRENASSGTEGGFSLYDGDKLVFEYYWDCPWSGSNSDELTVKDKENYTVIKKGGGSPTGASGNMYITVVKKS

SEQ ID NO: 656 - protein, 146 aa, Artificial Sequence
  AfIP-1A-31 variant
MTAKDIATEESKIRAYAQWIEITIFVVNSNFKVEGAFVRWGKFHLPGDKDKEISPSQINGTIIKDEDSYTIASCGRENASSGTEGGFSLYDGDKLVFEYYWDCPWSGSNSDELTVKDKENYTVIKKGGGSPTGATGNVFITVVKKS

SEQ ID NO: 657 - protein, 146 aa, Artificial Sequence
  AfIP-1A-31 variant
MTAKDIATEESKIRAYAQWIEITIFVVNSNFKVEGAYVRWGKFHVAGDKDKEISPSQINGTIIKDEDSYTIASCGRENASSGTEGGFSLYDGDKLVFEYYWDCPWSGSNSDELTVKDKENYTVIKKGGGSPSASSGNIFITVVKKS

SEQ ID NO: 658 - protein, 146 aa, Artificial Sequence
  AfIP-1A-31 variant
MTAKDIATEESKIRAYAQWIEITIFVVNSNFKVEGAFVKWGKFHVAGDKDKEISPSQINGTIIKDEDSYTIASCGRENASSGTEGGFSLYDGDKLVFEYYWDCPWSGSNSDELTVKDKENYTVIKKGGGSPTGSAGNMYITVVKKS

SEQ ID NO: 659 - protein, 146 aa, Artificial Sequence
  AfIP-1A-31 variant
MTAKDIATEESKIRAYAQWIEITIFVVNSNFKVEGAFIRWGKFHVPGDKDKEISPSQINGTIIKDEDSYTIASCGRENASSGTEGGFSLYDGDKLVFEYYWDCPWSGSNSDELTVKDKENYTVIKKGGGSPAGATGELYITVVKKS

SEQ ID NO: 660 - protein, 146 aa, Artificial Sequence
  AfIP-1A-31 variant
MTAKDIATEESKIRAYAQWIEITIFVVNSNFKVEGSYMKWGKFHVPGDKDKEISPSQINGTIIKDEDSYTIASCGRENASSGTEGGFSLYDGDKLVFEYYWDCPWSGSNSDELTVKDKENYTVIKKGGGSPSGASGEIYITVVKKS

SEQ ID NO: 661 - protein, 146 aa, Artificial Sequence
  AfIP-1A-31 variant
MTAKDIATEESKIRAYAQWIEITIFVVNSNFKVEGSFVRWGKFHMPGDKDKEISPSQINGTIIKDEDSYTIASCGRENASSGTEGGFSLYDGDKLVFEYYWDCPWSGSNSDELTVKDKENYTVIKKGGGSPSGATGNMYITVVKKS

SEQ ID NO: 662 - protein, 146 aa, Artificial Sequence
  AfIP-1A-31 variant
MTAKDIATEESKIRAYAQWIEITIFVVNSNFKVEGAYLRWGKFHVAGDKDKEISPSQINGTIIKDEDSYTIASCGRENASSGTEGGFSLYDGDKLVFEYYWDCPWSGSNSDELTVKDKENYTVIKKGGGSPTASTGNLYITVVKKS

SEQ ID NO: 663 - protein, 146 aa, Artificial Sequence
  AfIP-1A-31 variant
MTAKDIATEESKIRAYAQWIEITIFVVNSNFKVEGAYVRWGKFHVPGDKDKEISPSQINGTIIKDEDSYTIASCGRENASSGTEGGFSLYDGDKLVFEYYWDCPWSGSNSDELTVKDKENYTVIKKGGGSPTGSAGKIYITVVKKS

SEQ ID NO: 664 - protein, 146 aa, Artificial Sequence
  AfIP-1A-31 variant
MTAKDIATEESKIRAYAQWIEITIFVVNSNFKVEGAYVKWGKFHVAGDKDKEISPSQINGTIIKDEDSYTIASCGRENASSGTEGGFSLYDGDKLVFEYYWDCPWSGSNSDELTVKDKENYTVIKKGGGSPTSSTGNVYITVVKKS

SEQ ID NO: 665 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcgacgggcaatctcttcattactgttgtcaaaaaatcc

SEQ ID NO: 666 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgtcgacgacgggcaaagtgttcattactgttgtcaaaaaatcc

SEQ ID NO: 667 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcatgaggtggggaaagttccatctcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggggtcgtcgggcaatatcttcattactgttgtcaaaaaatcc

SEQ ID NO: 668 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcttatctgaggtggggaaagttccatctcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgtggacgtcgggcaaagtctacattactgttgtcaaaaaatcc

SEQ ID NO: 669 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtgaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggcggcgacgggcaatatctacattactgttgtcaaaaaatcc

SEQ ID NO: 670 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtacgttcgtgaggtggggaaagttccatgtccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcgtcgacgacgggcgaagtgttcattactgttgtcaaaaaatcc

SEQ ID NO: 671 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacctcaagtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgtgggcgacgggcaatctctacattactgttgtcaaaaaatcc

SEQ ID NO: 672 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcctcaggtggggaaagttccatgtccccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgggggcgtcgggcaatatgtacattactgttgtcaaaaaatcc

SEQ ID NO: 673 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtgaggtggggaaagttccatctgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgggggcgacgggcaatgtcttcattactgttgtcaaaaaatcc

SEQ ID NO: 674 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaggtggggaaagttccatgtcgccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcggcgtcgtcgggcaatatcttcattactgttgtcaaaaaatcc

SEQ ID NO: 675 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcgtcaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcggcgggcaatatgtacattactgttgtcaaaaaatcc

SEQ ID NO: 676 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgttcatcaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccagcgggggcgacgggcgaactgtacattactgttgtcaaaaaatcc

SEQ ID NO: 677 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgtacatgaagtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcgtcgggcgaaatctacattactgttgtcaaaaaatcc

SEQ ID NO: 678 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggttcgttcgtgaggtggggaaagttccatatgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccatcgggggcgacgggcaatatgtacattactgttgtcaaaaaatcc

SEQ ID NO: 679 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacctgaggtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggcgtcgacgggcaatctctacattactgttgtcaaaaaatcc

SEQ ID NO: 680 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaggtggggaaagttccatgtgcccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacggggtcggcgggcaaaatctacattactgttgtcaaaaaatcc

SEQ ID NO: 681 - DNA, 438 bp, Artificial Sequence
  AfIP-1A-31 variant
atgactgctaaagatattgcaactgaagaaagcaagattcgggcttatgcgcaatggatagaaattaccatattcgttgttaactcaaacttcaaagtagaaggtgcgtacgtgaagtggggaaagttccatgtggccggagataaagacaaggaaataagtcccagccaaattaatggcaccattatcaaagacgaagactcatacaccattgcctcctgcggacgcgagaacgcctcgtcaggaactgaaggaggtttctccctgtacgacggtgataaattagtttttgaatattactgggattgcccctggagtggttccaacagcgatgagctcaccgttaaggataaagaaaactacacagtgattaaaaaaggtggcggtagcccaacgtcgtcgacgggcaatgtctacattactgttgtcaaaaaatcc

SEQ ID NO: 682 - DNA, 25 bp, Artificial Sequence
  mutagenesis primer
accttctactttgaagtttgagtta

SEQ ID NO: 683 - DNA, 20 bp, Artificial Sequence
  mutagenesis primer
taatacgactcactataggg

SEQ ID NO: 684 - DNA, 25 bp, Artificial Sequence
  mutagenesis primer
atccggatatagttcctcctttcag

SEQ ID NO: 685 - DNA, 84 bp, Artificial Sequence
  mutagenesis primer
  misc_feature (26)..(26): d is a, g or t
  misc_feature (30)..(30): w is a or t
  misc_feature (32)..(32): v is a, c or g
  misc_feature (34)..(34): s is g or c
  misc_feature (36)..(36): r is a or g
  misc_feature (53)..(53): v is a, c or g
  misc_feature (55)..(56): s is g or c
taactcaaacttcaaagtagaaggtdcgtwcvtsargtggggaaagttccatvtssccggagataaagacaaggaaataagtcc

SEQ ID NO: 686 - DNA, 82 bp, Artificial Sequence
  mutagenesis primer
  misc_feature (35)..(35): w is a or t
  misc_feature (37)..(37): s is g or c
  misc_feature (39)..(39): b is c, g or t
  misc_feature (40)..(40): w is a or t
  misc_feature (42)..(42): y is c or t
  misc_feature (48)..(48): h is a, c or t
  misc_feature (51)..(51): h is a, c or t
  misc_feature (53)..(53): s is g or c
  misc_feature (54)..(54): m is a or c
  misc_feature (57)..(57): h is a, c or t
gtggtgctcgagggattttttgacaacagtaatgwasabwtygcccghcghcsmcghtgggctaccgccaccttttttaatc

SEQ ID NO: 687 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGLLRLAELMLGQLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 688 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGWLRFAELELGMLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 689 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGRLRLAELALGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 690 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGWLRVAELALGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 691 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGCLRFAELALGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 692 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGCLRGAELNLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 693 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGLLRGAELALGVLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 694 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGPLRRAQLVLGVLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 695 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRVAELILGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 696 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGLLRSAELVLGFLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 697 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGVLRLAGLELGCLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 698 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGYLRVAELALGVLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 699 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGVLRCAELALGILIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 700 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGALRRAELTLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 701 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGVLRIAELQLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 702 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGALRGAELTLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 703 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGSLRFAELALGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 704 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGPLRLAGLALGRLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 705 - protein, 715 aa, Artificial Sequence
  AfIP-1B-32 variant
AFIPBVARIANTMDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGFLRIAELALGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 706 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGPLRNAELGLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 707 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGPLRNAELGLGCLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 708 - protein, 703 aa, Artificial Sequence
  AfIP-1B-32 variant
MDIEAKSINPLMGITVGSTVLGNDFKPSVLINPITRMITQKEIEMGMSGKSQYVYTDSLNEGTIGFSGAYGPSGIAKFTSAVAVSVSNATASEYKSIKVSYNISMISGIEYIDFDNLTVEDVLNSLSAGPKNLSLKVLEKFIAARDCSGSSIEKDELMKEWVKSLQNFISSYGDGLVVGAIWGGMGSVSTEMTSKKTEDSWKYGETAEFSYSGIGSSVSIAQTYNGSQKDQSSEVEVSCKALASGGCVESQVNSWFDVVANKSFAEISGISLLDKAPMQSSVSPPPKIPDFLKPEKNAEITEKLDTIKKLGDSEEFALASGYEEAKKTNPNLTFEEFKSTVRDKNNIDGLNELASKVQENSLDVLAEGSISRRNKNLSLQGVRTISLDSSSDYAVLGAWIANWSDIFPWMSMGYMNEISDAEVAEYILKIRCMMQDLSTLNTIYNTFNACNIKLDFCHLNSASQVADSFKIAQGVLSDNVESDDAVEIAFNSLSDEAKKIYTAWNEIGWLRSAELTLGLLIGDQSVSSEIIDVKPIPYPEVTYKAAYCSYGNNNPTAFSSFIKMLPFIDTNGDIYAFGPSLMLLRKALPEKMIFTKGGEMAMKLTADKDTGILTNDSVKLIPIPYSAAKGIQWRGQGQGRSLASSQSLQDQFAALEKELGNLNICTLSSDSWSKDWTYTVPYTLRKISTTYIGTVEKINSIFG

SEQ ID NO: 709 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttgttgcgcctcgcggagcttatgctgggccagctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 710 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttggttgcgcttcgcgcagcttgagctgggcatgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 711 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtcggttgcgcctcgcggagcttgcgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 712 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttggttgcgcgtcgcggagcttgcgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 713 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttgcttgcgcttcgcggagcttgcgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 714 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttgcttgcgcggcgcggagcttaacctgggcctgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 715 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtctgttgcgcggcgcggagcttgccctgggcgtcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 716 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtccgttgcgccgcgcgcagcttgtcctgggcgtcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 717 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcgtcgcggagcttatcctgggcctcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 718 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtctcttgcgcagcgcggagcttgtcctgggcttcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 719 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtgtcttgcgcctcgcggggcttgagctgggctgcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 720 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttacttgcgcgtcgcggagcttgcgctgggcgtgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 721 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtgtgttgcgctgcgcggagcttgccctgggcatcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 722 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtgcgttgcgccgcgcggagcttacgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 723 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtgtcttgcgcatcgcggagcttcagctgggcctcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 724 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtgcgttgcgcggcgcggagcttaccctgggcctcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 725 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttcgttgcgcttcgcggagcttgcgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 726 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtccgttgcgcctcgcggggcttgcgctgggccggctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 727 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcatcgcggagcttgcgctgggcctcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 728 - DNA, 2109 bp, Artificial Sequence; identical to SEQ ID NO: 3
  AfIP-1B-32 variant

SEQ ID NO: 729 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggtttcttgcgcaacgcggagcttggcctgggctgcctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 730 - DNA, 2109 bp, Artificial Sequence
  AfIP-1B-32 variant
atggacatagaagctaaatccatcaatccattaatgggaatcacagttggatctactgttcttgggaatgattttaaaccttcagttctgataaatccaattaccagaatgattacccaaaaagaaattgaaatgggtatgagtggtaaaagccaatatgtctacactgactccttgaacgagggaaccattggcttttcaggagcctatggtccctcggggatcgccaagtttacctctgcagttgctgtatccgtcagcaatgcaactgcttcggagtacaagtctataaaagtctcctacaatatttccatgatctcgggaatagaatatatcgactttgacaatctgacggtagaggacgtattaaactctttaagtgcaggacctaaaaatctttcgttaaaggttttagagaaattcattgctgcccgtgactgctctggatcgtctatagaaaaagacgagctcatgaaagaatgggtcaaatctctgcagaacttcatttcatcctacggggatggtctggtcgtgggagccatctggggtggaatgggctctgtttctacggagatgacgagcaaaaaaacagaagacagctggaagtatggagaaacggctgaattcagctattcagggataggaagttccgtatccatagcgcaaacctataatggatctcaaaaagatcaaagctctgaagttgaggtatcttgcaaggctctcgccagtgggggttgcgttgaaagccaggtaaattcctggtttgatgttgttgccaacaagtcctttgccgagatttcaggaattagcctgctggataaagcgccaatgcaaagctcggtaagccctcctccaaaaatccctgattttctcaaaccggaaaaaaatgcagagataacggaaaagctggataccattaaaaagctgggcgattctgaagagttcgcgcttgcgtccggatatgaagaagccaaaaaaacaaatccgaacttaacttttgaagaattcaaatcaactgttcgggacaagaacaatattgatggcttgaatgagctggcatccaaagtccaggaaaattcattggatgtgctagcagaaggcagcatttccagaaggaataaaaacctctcgcttcaaggggttagaacaatcagcttagattcaagctcagactacgccgttttaggcgcctggatagcgaattggtcagatattttcccatggatgtcgatgggatacatgaacgaaatcagtgatgctgaggttgcggagtacatcctgaaaatccgttgcatgatgcaagatttgtctaccttgaatactatttacaatacttttaacgcatgcaacattaaactggatttctgccatcttaattccgcatctcaagtcgctgattcttttaaaattgcacaaggagtattaagcgacaacgtagagagtgacgatgcggtagaaatcgcattcaattccttaagcgatgaagccaagaagatttataccgcctggaacgaaattggttggttgcgcagcgcggagcttacgctgggcttgctcattggggatcagtcagtaagcagtgaaattatcgacgttaagccgataccgtatcccgaggtcacctacaaggcagcttattgcagctatggaaacaacaacccgactgcttttagctcgttcataaagatgcttccattcattgatacgaatggtgatatttatgccttcgggccatccctgatgctattgcgaaaagctttgcctgaaaaaatgattttcaccaaaggcggagaaatggcaatgaagctaacggctgataaagacacagggattctgactaacgacagtgtcaagttgatacctattccatactctgccgccaagggaattcaatggcgggggcaaggccaaggtcggagtcttgcgtcaagccaatccttacaagatcaatttgctgccttggaaaaagaactgggcaatctcaacatttgcaccttaagcagcgattcctggtctaaggattggacttataccgttccctacaccctgagaaaaataagcactacctatatcggaaccgttgagaaaatcaacagtatatttgga

SEQ ID NO: 731 - DNA, 20 bp, Artificial Sequence
  mutagenesis primer
ggaaagttccatgtgccagg

SEQ ID NO: 732 - DNA, 21 bp, Artificial Sequence
  mutagenesis primer
ccacctcagataagcaccttc

SEQ ID NO: 733 - DNA, 44 bp, Artificial Sequence
  mutagenesis primer
  misc_feature (27)..(27): n is a, c, g, or t
ggaaagttccatgtgccaggagatttngacaaggaaataagtcc

SEQ ID NO: 734 - DNA, 44 bp, Artificial Sequence
  mutagenesis primer
  misc_feature (30)..(30): n is a, c, g, or t
ggaaagttccatgtgccaggagataaattnaaggaaataagtcc

SEQ ID NO: 735 - DNA, 22 bp, Artificial Sequence
  mutagenesis primer
ccatgtgccaggagataaagac

SEQ ID NO: 736 - DNA, 36 bp, Artificial Sequence
  mutagenesis primer
  misc_feature (25)..(25): n is a, c, g, or t
ccatgtgccaggagataaagacttngaaataagtcc

SEQ ID NO: 737 - DNA, 23 bp, Artificial Sequence
  mutagenesis primer
aactttccccacctcagataagc

SEQ ID NO: 738 - DNA, 21 bp, Artificial Sequence
  mutagenesis primer
gtgccaggagataaagacaag

SEQ ID NO: 739 - DNA, 21 bp, Artificial Sequence
  mutagenesis primer
atggaactttccccacctcag

SEQ ID NO: 740 - DNA, 36 bp, Artificial Sequence
  mutagenesis primer
  misc_feature (24)..(24): n is a, c, g, or t
gtgccaggagataaagacaagttnataagtcccagc

SEQ ID NO: 741 - DNA, 48 bp, Artificial Sequence
  mutagenesis primer
  misc_feature (30)..(30): n is a, c, g, or t
gtgccaggagataaagacaaggaaatattncccagccaaattaatggc

SEQ ID NO: 742 - DNA, 21 bp, Artificial Sequence
  mutagenesis primer
atggaactttccccacctcag

SEQ ID NO: 743 - DNA, 21 bp, Artificial Sequence
  mutagenesis primer
gtgccaggagataaagacaag

SEQ ID NO: 744 - DNA, 21 bp, Artificial Sequence
  mutagenesis primer
gataaagacaaggaaataagt

SEQ ID NO: 745 - DNA, 39 bp, Artificial Sequence
  mutagenesis primer
  misc_feature (24)..(24): n is a, c, g, or t
gataaagacaaggaaataagtttnagccaaattaatggc

SEQ ID NO: 746 - DNA, 21 bp, Artificial Sequence
  mutagenesis primer
tcctggcacatggaactttcc

SEQ ID NO: 747 - DNA, 30 bp, Artificial Sequence
  mutagenesis primer
gatattttcccatggatgtcgatgggatac

SEQ ID NO: 748 - DNA, 24 bp, Artificial Sequence
  mutagenesis primer
accaatttcgttccaggcggtata

SEQ ID NO: 749 - DNA, 80 bp, Artificial Sequence
  mutagenesis primer
  misc_feature (23)..(23): n is a, c, g, or t
  misc_feature (31)..(31): n is a, c, g, or t
  misc_feature (52)..(52): n is a, c, g, or t
accgcctggaacgaaattggtbnsttgcgcnkcgcgsrgcttvhsctgggcndsctcattggggatcagtcagtaagcag

SEQ ID NO: 750 - DNA, 22 bp, Artificial Sequence
  mutagenesis primer
atccggatatagttcctccttt

SEQ ID NO: 751 - DNA, 23 bp, Artificial Sequence
  mutagenesis primer
aatattgtaggagacttttatag

SEQ ID NO: 752 - DNA, 42 bp, Artificial Sequence
  mutagenesis primer
  misc_feature (21)..(22): n is a, c, g, or t
  misc_feature (23)..(23): k is g or t
ctataaaagtctcctacaatnnktccatgatctcgggaatag

SEQ ID NO: 753 - DNA, 21 bp, Artificial Sequence
  mutagenesis primer
catggaaatattgtaggagac

SEQ ID NO: 754 - DNA, 43 bp, Artificial Sequence
  mutagenesis primer
  misc_feature (19)..(20): n is a, c, g, or t
  misc_feature (21)..(21): k is g or t
gtctcctacaatatttccnnkatctcgggaatagaatatatcg

SEQ ID NO: 755 - DNA, 23 bp, Artificial Sequence
  mutagenesis primer
cgagatcatggaaatattgtagg

SEQ ID NO: 756 - DNA, 41 bp, Artificial Sequence
  mutagenesis primer
  misc_feature (21)..(22): n is a, c, g, or t
  misc_feature (23)..(23): k is g or t
cctacaatatttccatgatcnnkggaatagaatatatcgac

SEQ ID NO: 757 - DNA, 25 bp, Artificial Sequence
  mutagenesis primer
tattcccgagatcatggaaatattg

SEQ ID NO: 758 - DNA, 43 bp, Artificial Sequence
  mutagenesis primer
  misc_feature (23)..(24): n is a, c, g, or t
  misc_feature (25)..(25): k is g or t
caatatttccatgatctcgggannkgaatatatcgactttgac

SEQ ID NO: 759 - DNA, 20 bp, Artificial Sequence
  mutagenesis primer
ttctattcccgagatcatgg

SEQ ID NO: 760 - DNA, 41 bp, Artificial Sequence
  mutagenesis primer
  misc_feature (18)..(19): n is a, c, g, or t
  misc_feature (20)..(20): k is g or t
ccatgatctcgggaatannktatatcgactttgacaatctg

SEQ ID NO: 761 - DNA, 24 bp, Artificial Sequence
  mutagenesis primer
tttggatgccagctcattcaagcc

SEQ ID NO: 762 - DNA, 43 bp, Artificial Sequence
  mutagenesis primer
  misc_feature (22)..(23): n is a, c, g, or t
  misc_feature (24)..(24): k is g or t
ggcttgaatgagctggcatccnnkgtccaggaaaattcattgg

SEQ ID NO: 763 - DNA, 22 bp, Artificial Sequence
  mutagenesis primer
ttcctggactttggatgccagc

SEQ ID NO: 764 - DNA, 42 bp, Artificial Sequence
  mutagenesis primer
  misc_feature (20)..(21): n is a, c, g, or t
  misc_feature (22)..(22): k is g or t
gctggcatccaaagtccagnnkaattcattggatgtgctagc

SEQ ID NO: 765 - DNA, 20 bp, Artificial Sequence
  mutagenesis primer
tgaattttcctggactttgg

SEQ ID NO: 766 - DNA, 41 bp, Artificial Sequence
  mutagenesis primer
  misc_feature (18)..(19): n is a, c, g, or t
  misc_feature (20)..(20): k is g or t
ccaaagtccaggaaaatnnkttggatgtgctagcagaaggc

SEQ ID NO: 767 - DNA, 21 bp, Artificial Sequence
  mutagenesis primer
atccaatgaattttcctggac

SEQ ID NO: 768 - DNA, 45 bp, Artificial Sequence
  mutagenesis primer
  misc_feature (19)..(20): n is a, c, g, or t
  misc_feature (21)..(21): k is g or t
gtccaggaaaattcattgnnkgtgctagcagaaggcagcatttcc

SEQ ID NO: 769 - DNA, 25 bp, Artificial Sequence
  mutagenesis primer
tagcacatccaatgaattttcctgg

SEQ ID NO: 770 - DNA, 43 bp, Artificial Sequence
  mutagenesis primer
  misc_feature (23)..(24): n is a, c, g, or t
  misc_feature (25)..(25): k is g or t
ccaggaaaattcattggatgtgnnkgcagaaggcagcatttcc

SEQ ID NO: 771 - DNA, 20 bp, Artificial Sequence
  mutagenesis primer
gaaaccaatttcgttccagg

SEQ ID NO: 772 - DNA, 42 bp, Artificial Sequence
  mutagenesis primer
  misc_feature (18)..(19): n is a, c, g, or t
  misc_feature (20)..(20): k is g or t
cctggaacgaaattggtnnkttgcgcaacgcggagcttggcc

SEQ ID NO: 773 - DNA, 21 bp, Artificial Sequence
  mutagenesis primer
ctccgcgttgcgcaagaaacc

SEQ ID NO: 774 - DNA, 39 bp, Artificial Sequence
  mutagenesis primer
  misc_feature (19)..(20): n is a, c, g, or t
  misc_feature (21)..(21): k is g or t
ggtttcttgcgcaacgcgnnkcttggcctgggcctgctc

SEQ ID NO: 775 - DNA, 22 bp, Artificial Sequence
  mutagenesis primer
caggcccaggccaagctccgcg

SEQ ID NO: 776 - DNA, 46 bp, Artificial Sequence
  mutagenesis primer
  misc_feature (20)..(21): n is a, c, g, or t
  misc_feature (22)..(22): k is g or t
cgcggagcttggcctgggcnnkctcattggggatcagtcagtaagc

That which is claimed:

1. A recombinant nucleic acid molecule encoding an *Alcaligenes faecalis* Insecticidal polypeptide-1A (AfIP-1A polypeptide) operably linked to a heterologous regulatory element, wherein the AfIP-1A polypeptide has at least 85% identity to the amino acid sequence of SEQ ID NO: 2.

2. The recombinant nucleic acid molecule of claim 1, wherein the AfIP-1A polypeptide comprises the amino acid sequence of SEQ ID NO: 257, wherein

```
Xaa at position 6 is Ile, Thr, Leu, Met, Val or Ser;

Xaa at position 7 is Ala, Met, Val, Leu, Ile or Gly;

Xaa at position 8 is Thr, Asp, Ser or Glu;

Xaa at position 9 is Glu, Leu, Gly, Asp, Ala, Ile, Val or Met;

Xaa at position 10 is Glu, Asn, Asp or Gln;

Xaa at position 11 is Ser, Val, Thr, Ile, Leu or Met;

Xaa at position 12 is Lys, Glu, Arg or Asp;

Xaa at position 13 is Ile, Val, Leu or Met;

Xaa at position 14 is Arg, Gln, Lys or Asn;

Xaa at position 16 is Tyr, Gln, Trp, Phe or Asn;

Xaa at position 17 is Ala, Ser, Gly or Thr;

Xaa at position 19 is Trp, Glu, Phe, Ile, His, Asn or Tyr;

Xaa at position 20 is Ile, Val, Ala, Cys, Glu, Phe, Gly, Met, Asn,
Gln, Arg, Ser or Thr;

Xaa at position 23 is Thr, Glu, Ala, Ser, Asp or Gly;

Xaa at position 24 is Ile, Leu, Val or Met;

Xaa at position 26 is Val, Ser, Ile, Leu, Met or Thr;

Xaa at position 27 is Val, Glu, Ile, Leu, Met or Asp;

Xaa at position 29 is Ser, Met, Thr, Ile, Leu or Val;

Xaa at position 30 is Asn, Asp, Ser, Glu, Gln or Thr;

Xaa at position 31 is Phe, Ile, Leu, Val or Met;

Xaa at position 32 is Lys, Glu, Arg or Asp;

Xaa at position 33 is Val, Ile, Leu or Met;

Xaa at position 34 is Glu, Lys, Asp or Arg;
```

-continued

Xaa at position 35 is Gly or Asn;

Xaa at position 36 is Ala, Gly, Asp, Glu, Phe, Gly, Ile, Leu, Pro, Gln, Arg, Ser, Thr, Val, Trp or Tyr;

Xaa at position 37 is Tyr, Ala, Cys, Asp, Glu, Gly, His, Ile, Lys, Leu, Met, Pro, Arg, Ser, Thr, Val or Trp;

Xaa at position 38 is Leu, Ala, Cys, Asp, Glu, Phe, Gly, His, Ile, Lys, Met, Gln, Arg, Ser, Thr, Val, Trp or Tyr;

Xaa at position 39 is Arg, Lys, Cys, Asp, Glu, Phe, Gly, Ile, Lys, Leu, Met, Asn, Pro, Ser, Thr, Val, Trp or Tyr;

Xaa at position 40 is Trp, Ala, Cys, Asp, Glu, Phe, Gly, His, Ile, Lys, Leu, Met, Asn, Pro, Gln, Arg, Ser, Thr, Val or Tyr;

Xaa at position 41 is Gly, Cys or Gln;

Xaa at position 42 is Lys, Cys, Glu, His, Leu, Met, Asn, Gln, Arg or Thr;

Xaa at position 43 is Phe, Tyr, Ala, Cys, Glu, Ile, Leu, Met, Gln, Ser, Val or Trp;

Xaa at position 44 is His, Ala, Asp, Glu, Gly, Lys, Leu, Met, Asn, Pro, Glu, Arg, Ser, Thr, Val, Trp;

Xaa at position 45 is Val, Ala, Cys, Asp, Glu, Phe, Gly, His, Ile, Lys, Leu, Asn, Pro, Gln, Arg, Ser, Thr or Trp;

Xaa at position 46 is Pro, Ala, Cys, Asp, Glu, Gly, His, Lys, Leu, Met, Gln, Arg, Ser, Thr, Val, Trp or Tyr;

Xaa at position 47 is Gly, Leu or Phe;

Xaa at position 48 is Asp, Asn, Glu, Gln, Leu or Phe;

Xaa at position 50 is Asp, Ser, Glu, Thr, Leu or Phe;

Xaa at position 51 is Lys, Asn, Arg, Gln, Leu or Phe;

Xaa at position 52 is Glu, Leu or Phe;

Xaa at position 53 is Ile, Leu or Phe;

Xaa at position 54 is Ser, Thr, Leu or Phe;

Xaa at position 55 is Pro, Ser, Thr, Leu or Phe;

Xaa at position 56 is Ser, Asp, Thr, Glu or Leu;

Xaa at position 57 is Gln, Thr, Glu, Asn, Ser, Asp, Leu or Phe;

Xaa at position 58 is Ile, Val, Leu, Met or Phe;

Xaa at position 60 is Gly, Lys, Ala or Arg;

Xaa at position 61 is Thr, Ile or Phe;

Xaa at position 62 is Ile, Lys, Val, Leu, Met, Arg or Phe;

Xaa at position 64 is Lys, Ser, Glu, Arg, Thr, Asp, Leu or Phe;

Xaa at position 65 is Asp, Ser, Glu, Thr, Leu or Phe;

Xaa at position 66 is Glu, Gly, Asp or Ala;

Xaa at position 67 is Asp, Thr, Glu or Ser;

Xaa at position 68 is Ser, Lys, Thr or Arg;

Xaa at position 69 is Tyr, Ser, Trp, Phe or Thr;

Xaa at position 70 is Thr, Lys, Ser or Arg;

Xaa at position 73 is Ser, Ala, Thr or Gly;

Xaa at position 74 is Cys, Ala, Asp, Glu, Gly, His, Ile, Lys, Leu, Asn, Pro, Gln, Arg, Ser, Thr or Tyr;

-continued

Xaa at position 76 is Arg, Cys, Asp, Glu, Phe, Gly, His, Ile, Lys, Leu, Met, Asn, Pro, Gln, Ser, Thr, Val, Trp or Tyr;

Xaa at position 77 is Glu, Ala, Asp or Gly;

Xaa at position 78 is Asn, Asp, Gln or Glu;

Xaa at position 79 is Ala, Thr, Gly or Ser;

Xaa at position 82 is Gly, Glu, Asn, Trp or Tyr;

Xaa at position 86 is Gly, Lys, Ala or Arg;

Xaa at position 88 is Ser, Glu, Thr or Asp;

Xaa at position 89 is Leu, Ile, Val or Met;

Xaa at position 91 is Asp, His or Glu;

Xaa at position 92 is Gly, Asp, Ala or Glu;

Xaa at position 95 is Leu, Trp, Ile, Val, Met, Phe or Tyr;

Xaa at position 96 is Val, Leu, Ile or Met;

Xaa at position 97 is Phe, Ala or Gly;

Xaa at position 98 is Glu, Thr, Asp or Ser;

Xaa at position 100 is Tyr, Lys, Trp or Arg;

Xaa at position 101 is Trp, Phe or Tyr;

Xaa at position 104 is Pro, Ala, Phe, Gly, His, Met, Gln, Arg or Val;

Xaa at position 105 is Trp, Asp, Phe, Ile, Leu or Tyr;

Xaa at position 106 is Ser, Ala, Thr or Gly;

Xaa at position 111 is Asp, His, Asn, Glu or Gln;

Xaa at position 112 is Glu, Ser, Asp or Thr;

Xaa at position 113 is Leu, Ser, Ile, Val, Met or Thr;

Xaa at position 114 is Thr or Ser;

Xaa at position 115 is Val, Ile, Val or Met;

Xaa at position 116 is Lys, Thr, Glu, Arg, Ser or Asp;

Xaa at position 117 is Asp or Glu;

Xaa at position 118 is Lys, Asp, Arg or Glu;

Xaa at position 119 is Glu, Asn, Asp or Gln;

Xaa at position 120 is Asn, Lys, Asp or Arg;

Xaa at position 121 is Tyr, Leu or Phe;

Xaa at position 122 is Thr, Lys, Ser, Arg, Leu or Phe;

Xaa at position 123 is Val, Ile, Leu, Met, Phe or Asn;

Xaa at position 124 is Ile, Ser, Asp, Leu, Val Met, Thr, Glu or Phe;

Xaa at position 125 is Lys, Leu, Phe or Met;

Xaa at position 126 is Lys, Glu, Arg, Asp, Leu or Phe;

Xaa at position 128 is Gly, Leu or Phe;

Xaa at position 129 is Gly, Asn, Ala, Gln, Leu or Phe;

Xaa at position 130 is Ser, Ile, Thr, Leu, Val, Met or Phe;

Xaa at position 131 is Pro, Ser or Thr;

Xaa at position 132 is Ser, Ala, Cys, Asp, Glu, Phe, Gly, His, Ile,

-continued

Lys, Leu, Met, Asn, Pro, Gln, Arg, Thr, Val, Trp or Tyr;

Xaa at position 133 is Gly, Ala, Cys, Asp, Glu, Phe, His, Ile, Lys, Leu, Met, Asn, Pro, Gln, Arg, Ser, Thr, Val or Trp;

Xaa at position 134 is Ala, Cys, Asp, Glu, Phe, Gly, His, Ile, Lys, Leu, Met, Asn, Pro, Gln, Arg, Ser, Thr, Val, Trp or Tyr;

Xaa at position 135 is Thr, Ala, Cys, Asp, Glu, Phe, Gly, His, Ile, Lys, Leu, Met, Asn, Pro, Gln, Arg, Ser, Val, Trp or Tyr;

Xaa at position 136 is Gly, Ala, Cys, Asp, Glu, Phe, His, Ile, Lys, Leu, Met, Asn, Pro, Gln, Arg, Ser, Thr, Val, Trp or Tyr;

Xaa at position 137 is Asn, Ala, Cys, Asp, Glu, Phe, Gly, His, Ile, Lys, Leu, Met, Pro, Glu, Arg, Ser, Thr, Val, Trp or Tyr;

Xaa at position 138 is Ile, Ala, Cys, Asp, Glu, Phe, Gly, His, Lys, Leu, Met, Asn, Pro, Gln, Arg, Ser, Thr, Val, Trp or Tyr;

Xaa at position 139 is Phe, Ala, Cys, Asp, Glu, Gly, His, Ile, Lys, Leu, Met, Asn, Pro, Gln, Arg, Ser, Thr, Val, Trp or Tyr;

Xaa at position 140 is Ile, Ala, Cys, Phe, His, Leu, Met, Asn, Gln, Thr, Val or Tyr;

Xaa at position 142 is Val, Cys, Ile, Leu or Met;

Xaa at position 143 is Val, Ile; Leu or Met;

Xaa at position 145 is Lys, Val, Arg, Ile, Leu or Met; and

Xaa at position 146 is Ser, Gly, Thr or Ala;
and wherein, 1 to 14 amino acids are optionally deleted from the N-terminus of the polypeptide.

3. The recombinant nucleic acid molecule of claim 2, wherein the AfIP-1A polypeptide comprises the amino acid motifs as represented by positions 15-26 of SEQ ID NO: 257, positions 33-53 of SEQ ID NO: 257, positions 71-84 of SEQ ID NO: 257, and positions 100-107 of SEQ ID NO: 257.

4. The recombinant nucleic acid molecule of claim 1, wherein the nucleic acid molecule encodes an AfIP-1A polypeptide comprising an amino acid sequence of SEQ ID NO: 2 or SEQ ID NO: 94.

5. A transgenic plant, transgenic plant cell or progeny thereof, comprising the recombinant nucleic acid molecule of claim 1.

6. A transgenic plant, transgenic plant cell or progeny thereof stably transformed with the recombinant nucleic acid molecule of claim 1.

7. The transgenic plant, transgenic plant cell or progeny thereof of claim 6, wherein the transgenic plant is a monocotyledon.

8. The transgenic plant, transgenic plant cell or progeny thereof of claim 6, further comprising one or more additional transgenic traits.

9. An expression cassette, comprising the recombinant nucleic acid molecule of claim 1 and one or more regulatory sequences operably linked to and directing expression of the AfIP-1A polypeptide.

10. A transgenic plant or plant cell, comprising the expression cassette of claim 9.

11. Seed, grain or processed product thereof of the transgenic plant of claim 10 or a progeny thereof, wherein the seed, grain or processed product thereof comprises the recombinant nucleic acid molecule.

12. The seed of claim 11, wherein one or more seed treatment has been applied to the seed.

13. A transgenic plant capable of expressing a recombinant polynucleotide encoding an AfIP-1A polypeptide having at least 85% identity to the amino acid sequence of SEQ ID NO: 2.

14. The transgenic plant of claim 13, wherein the transgenic plant is a monocotyledon.

15. The transgenic plant of claim 13, wherein the transgenic plant expresses one or more additional transgenic traits.

16. A recombinant nucleic acid molecule encoding an *Alcaligenes faecalis* Insecticidal polypeptide-1B (AIIP-1B polypeptide) operably linked to a heterologous regulatory element, wherein the AfIP-1B polypeptide has at least 95% identity to the amino acid sequence of SEQ ID NO: 4.

17. The recombinant nucleic acid molecule of claim 16, wherein the AfIP-1B polypeptide comprises the amino acid sequence of SEQ ID NO: 259, wherein Xaa at position 12 is Met, Leu, Ile or Val;

Xaa at position 34 is Ile or Leu;

Xaa at position 38 is Ile or Leu;

Xaa at position 42 is Glu or Asp;

-continued

Xaa at position 43 is Ile or Leu;

Xaa at position 53 is Tyr or Phe;

Xaa at position 55 is Tyr or Phe;

Xaa at position 71 is Gly, Cys or Ala;

Xaa at position 86 is Val or Leu;

Xaa at position 94 is Tyr or Phe;

Xaa at position 97 is Ile or Leu;

Xaa at position 101 is Tyr or Phe;

Xaa at position 103 is Ile, Leu, Gly, Val, Trp, Phe, Thr, Cys, Glu or Arg;

Xaa at position 105 is Met, Gly, Val Leu, Trp, Phe, Pro, Thr, Cys, Asn, Gln or Arg;

Xaa at position 106 is Ile or Leu;

Xaa at position 108 is Gly, Ala, Leu, Val, Ile, Met, Trp, Phe, Ser, Thr, Cys, Tyr, Asn, Glu, Asp, Lys or His;

Xaa at position 109 is Ile, Leu, Ala, Val, Leu, Met, Trp, Phe, Pro, Cys, Asn or Glu;

Xaa at position 110 is Glu, Gly, Ala, Val, Leu, Met, Trp, Ser, Thr, Cys, Tyr, Asp, Arg or His;

Xaa at position 111 is Tyr, Gly, Ala, Val, Leu, Ile, Met, Trp, Ser, Thr, Cys, Asp, Glu, Lys, Arg or His;

Xaa at position 115 is Asp or Glu;

Xaa at position 119 is Val, Ala, Ile or Leu;

Xaa at position 134 is Ser or Leu;

Xaa at position 137 is Val, Phe, Ala, Leu, Trp, Pro, Ser, Cys, Asp, Glu or Arg;

Xaa at position 139 is Glu or Asp;

Xaa at position 141 is Phe, Val, Leu, Ile, Trp, Ser or Cys;

Xaa at position 144 is Ala, Val, Gly, Ile, Leu or Met;

Xaa at position 148 is Ser, Phe, Thr or Trp;

Xaa at position 152 is Ile, Thr, Leu, Val, Met or Ser;

Xaa at position 155 is Asp or Glu;

Xaa at position 179 is Gly, Val, Trp, Ser, Cys or Arg;

Xaa at position 181 is Ile, Val, Met or Leu;

Xaa at position 182 is Trp, Gly, Ala, Val, Leu, Met, Ser, Cys, Glu or Arg;

Xaa at position 188 is Val or Leu;

Xaa at position 196 is Lys or Glu;

Xaa at position 197 is Thr or Ser;

Xaa at position 201 is Trp, Cys, Tyr or Phe;

Xaa at position 202 is Lys, Asn or Arg;

Xaa at position 203 is Tyr or Phe;

-continued

Xaa at position 208 is Glu or Asp;

Xaa at position 214 is Ile or Leu;

Xaa at position 220 is Ile or Leu;

Xaa at position 224 is Tyr or Phe;

Xaa at position 234 is Glu or Asp;

Xaa at position 235 is Val or Leu;

Xaa at position 270 is Ile, Val, Leu or Met;

Xaa at position 296 is Lys or Glu;

Xaa at position 298 is Ala, Glu, Gly or Asp;

Xaa at position 299 is Glu, Gly, Asp or Ala;

Xaa at position 300 is Ile, Val, Ile or Met;

Xaa at position 305 is Asp or Glu;

Xaa at position 317 is Ala, Ser, Gly or Thr;

Xaa at position 323 is Glu or Asp;

Xaa at position 335 is Glu or Asp;

Xaa at position 352 is Glu or Asp;

Xaa at position 359 is Glu, Gly, Ala, Val, Leu, Trp, Phe, Pro, Ser, Thr, Lys or Arg;

Xaa at position 360 is Asn, Gly, Val, Leu, Ile, Met, Phe, Pro, Thr, Asn, Asp, Lys, Arg or His;

Xaa at position 361 is Ser, Gly, Val, Leu or Glu;

Xaa at position 363 is Asp, Gly, Leu, Ile, Trp or Ser;

Xaa at position 364 is Val, Pro, Ser, Thr, Asn, Gln, Asp, Glu or Lys;

Xaa at position 365 is Leu, Gly, Ala, Val, Ile, Trp, Phe, Pro, Ser, Thr, Cys, Tyr, Gln, Asp, Glu, Arg or His;

Xaa at position 367 is Glu or Lys;

Xaa at position 368 is Gly or Asp;

Xaa at position 370 is Ile, Val, Leu or Met;

Xaa at position 373 is Arg or Ser;

Xaa at position 374 is Asn, Lys, Gln or Arg;

Xaa at position 377 is Leu, Ile, Val or Met;

Xaa at position 384 is Thr, Ala, Ser or Gly;

Xaa at position 385 is Ile, Ser, Leu, Val, Met or Thr;

Xaa at position 388 is Asp or Glu;

Xaa at position 393 is Tyr, Phe or Trp;

Xaa at position 398 is Ala or Val;

Xaa at position 414 is Tyr or Phe;

Xaa at position 418 is Ile or Leu;

Xaa at position 419 is Ser, Asn, Thr or Gln;

Xaa at position 423 is Val or Leu;

-continued

Xaa at position 425 is Glu or Val;

Xaa at position 427 is Ile or Val;

Xaa at position 434 is Met or Thr;

Xaa at position 481 is Glu or Asp;

Xaa at position 495 is Asp or Glu;

Xaa at position 509 is Phe, Gly, Ala, Val, Leu, Ile, Met, Trp, Ser, Cys, Tyr, Asn, Asp, Glu or Arg;

Xaa at position 512 is Asn, Ser, Gly, Ala, Leu, Met, Trp, Phe, Ser, Thr, Cys, Gln or Arg;

Xaa at position 514 is Glu, Gly, Ile, Asp or Arg;

Xaa at position 516 is Gly, Ala, Val, Met, Pro, Thr, Asn, Gln, Asp, Glu or Lys;

Xaa at position 519 is Leu, Gly, Ala, Val, Met, Phe, Pro, Tyr, Gln, Asp, Lys or Arg;

Xaa at position 526 is Val or Leu;

Xaa at position 530 is Ile or Leu;

Xaa at position 533 is Val or Ala;

Xaa at position 536 is Ile or Leu;

Xaa at position 538 is Tyr, Phe or Trp;

Xaa at position 543 is Tyr or Phe;

Xaa at position 544 is Lys or Arg;

Xaa at position 547 is Tyr or Phe;

Xaa at position 550 is Tyr, Phe or Trp;

Xaa at position 552 is Asn, Ser, Gln or Thr;

Xaa at position 558 is Phe or Leu;

Xaa at position 600 is Met or Val;

Xaa at position 602 is Met, Ile, Leu or Val;

Xaa at position 607 is Asp or Gly;

Xaa at position 610 is Thr, Lys, Ser or Arg;

Xaa at position 612 is Ile or Thr;

Xaa at position 613 is Leu or Pro;

Xaa at position 615 is Asn or Asp;

Xaa at position 619 is Lys or Arg;

Xaa at position 625 is Tyr, Phe or Trp;

Xaa at position 631 is Ile, Val, Leu or Met;

Xaa at position 633 is Trp or Phe;

Xaa at position 646 is Gln or Arg;

Xaa at position 661 is Asn or Ser;

Xaa at position 683 is Thr, Ala, Ser or Gly;
and

Xaa at position 696 is Glu or Asp;

-continued

```
Xaa at position 700 is Ser or Gly;
and

Xaa at position 702 is Phe or Ser;
and

wherein, 1 to 25 amino acids are optionally deleted from the C-
terminus of the polypeptide.
```

18. The recombinant nucleic acid molecule of claim 17, wherein the AfIP-1B polypeptide comprises the amino acid motifs as represented by positions 105-115 of SEQ ID NO: 259, positions 133-144 of SEQ ID NO: 259, positions 177-184 of SEQ ID NO: 259, positions 358-365 of SEQ ID NO: 259, and positions 511-520 of SEQ ID NO: 259.

19. The recombinant nucleic acid molecule of claim 16, wherein the nucleic acid molecule encodes an AfIP-1B polypeptide comprises an amino acid sequence of SEQ ID NO: 4 or SEQ ID NO: 76.

20. A transgenic plant, transgenic plant cell or progeny thereof, comprising the recombinant nucleic acid molecule of claim 16.

21. A transgenic plant, transgenic plant cell or progeny thereof stably transformed with the recombinant nucleic acid molecule of claim 16.

22. The transgenic plant, transgenic plant cell or progeny thereof of claim 21, wherein the transgenic plant is a monocotyledon.

23. The transgenic plant, transgenic plant cell or progeny thereof of claim 21, further comprising one or more additional transgenic traits.

24. An expression cassette, comprising the recombinant nucleic acid molecule of claim 16 operably linked to one or more regulatory sequences directing expression of the AfIP-1B polypeptide.

25. A transgenic plant or plant cell, comprising the expression cassette of claim 24.

26. Seed, grain or processed product thereof of the transgenic plant of claim 25 or a progeny thereof, wherein the seed, grain or processed product thereof comprises the recombinant nucleic acid molecule.

27. The seed of claim 26, wherein one or more seed treatment has been applied to the seed.

28. A transgenic plant capable of expressing a recombinant polynucleotide encoding an AfIP-1B polypeptide having at least 95% identity to the amino acid sequence of SEQ ID NO: 4.

29. The transgenic plant of claim 28, wherein the transgenic plant is a monocotyledon.

30. The transgenic plant of claim 28, wherein the transgenic plant expresses one or more additional transgenic traits.

31. A transgenic plant or progeny thereof, comprising the recombinant nucleic acid molecule of claim 1 and the recombinant nucleic acid molecule of claim 16.

32. A transgenic plant or progeny thereof stably transformed with the recombinant nucleic acid molecule of claim 1 and the recombinant nucleic acid molecule of claim 16.

33. The transgenic plant or progeny thereof of claim 32, wherein the transgenic plant is a monocotyledon.

34. The transgenic plant or progeny thereof of claim 32, wherein the plant is selected from barley, corn, oat, rice, rye, sorghum, turf grass, sugarcane, wheat, alfalfa, banana, broccoli, bean, cabbage, canola, carrot, cassava, cauliflower, celery, citrus, cotton, a cucurbit, eucalyptus, flax, garlic, grape, onion, lettuce, pea, peanut, pepper, potato, poplar, pine, sunflower, safflower, soybean, strawberry, sugar beet, sweet potato, tobacco, tomato ornamental, shrub, nut, chickpea, pigeon pea, millets, hops and pasture grasses.

35. The transgenic plant or progeny thereof of claim 32, further comprising one or more additional transgenic traits.

36. The transgenic plant of claim 35, wherein the one or more additional transgenic trait is selected from insect resistance, herbicide resistance, fungal resistance, viral resistance, stress tolerance, disease resistance, male sterility, stalk strength, increased yield, modified starches, improved oil profile, balanced amino acids, high lysine or methionine, increased digestibility, improved fiber quality, flowering, ear and seed development, enhancement of nitrogen utilization efficiency, altered nitrogen responsiveness, drought resistance or tolerance, cold resistance or tolerance, salt resistance or tolerance and increased yield under stress.

37. Seed, grain or processed product thereof of the transgenic plant of claim 32, wherein the seed, grain, or processed product thereof comprises the recombinant nucleic acid molecule of claim 1 and the recombinant nucleic acid molecule of 16.

38. An expression cassette, comprising the recombinant nucleic acid molecule of claim 1 operably linked to one or more regulatory sequences directing expression of an AfIP-1A polypeptide and the recombinant nucleic acid molecule of claim 16 operably linked to one or more regulatory sequences directing expression of an AfIP-1B polypeptide.

39. A transgenic plant or plant cell, comprising the expression cassette of claim 38.

40. Seed, grain or processed product thereof of the transgenic plant of claim 39, wherein the seed, grain, or processed product thereof comprises the recombinant nucleic acid molecule of claim 1 and the recombinant nucleic acid molecule of 16.

41. The seed of claim 40, wherein one or more seed treatment has been applied to the seed.

42. A method for expressing in a plant a polynucleotide encoding an insecticidal protein, comprising (a) inserting into a plant cell the recombinant nucleic acid molecule of claim 1 encoding an AfIP-1A polypeptide; and the recombinant nucleic acid molecule of claim 16 encoding an AfIP-1B polypeptide;

(b) obtaining a transformed plant cell comprising the nucleic acid sequence of step (a); and (c) generating from the transformed plant cell a plant capable of expressing the nucleic acid molecules encoding an AfIP-1A polypeptide and an AfIP-1B polypeptide.

43. A method for protecting a plant from an insect pest, comprising expressing in the plant or cell thereof, an insecticidally-effective amount of an AfIP-1A polypeptide having at least 85% identity to the amino acid sequence of SEQ ID NO: 2 and an AfIP-1B polypeptide having at least 95% identity to the amino acid sequence of SEQ ID NO: 24.

44. A fusion protein comprising a recombinant AfIP-1A polypeptide having at least 85% identity to the amino acid sequence of SEQ ID NO: 2.

45. A fusion protein comprising a recombinant AfIP-1B polypeptide having at least 95% identity to the amino acid sequence of SEQ ID NO: 4.

46. A fusion protein comprising a recombinant AfIP-1A polypeptide having at least 85% identity to the amino acid sequence of SEQ ID NO: 2 and a recombinant AfIP-1B polypeptide having at least 95% identity to the amino acid sequence of SEQ ID NO: 4.

* * * * *